(12) United States Patent
Yang et al.

(10) Patent No.: US 12,060,424 B2
(45) Date of Patent: Aug. 13, 2024

(54) RELEASE SEGMENTS AND BINDING COMPOSITIONS COMPRISING SAME

(71) Applicant: AMUNIX PHARMACEUTICALS, INC., Mountain View, CA (US)

(72) Inventors: Fan Yang, San Jose, CA (US); Volker Schellenberger, Palo Alto, CA (US); Vladimir Podust, Castro Valley, CA (US); Bee-Cheng Sim, Mountain View, CA (US); Desiree Thayer, Burlingame, CA (US); John Beaber, Redwood City, CA (US)

(73) Assignee: AMUNIX PHARMACEUTICALS, INC., South San Francisco, CA (US)

( * ) Notice: Subject to any disclaimer, the term of this patent is extended or adjusted under 35 U.S.C. 154(b) by 737 days.

(21) Appl. No.: 16/954,145

(22) PCT Filed: Dec. 20, 2018

(86) PCT No.: PCT/US2018/066939
§ 371 (c)(1),
(2) Date: Jun. 16, 2020

(87) PCT Pub. No.: WO2019/126576
PCT Pub. Date: Jun. 27, 2019

(65) Prior Publication Data
US 2020/0385469 A1    Dec. 10, 2020

Related U.S. Application Data

(60) Provisional application No. 62/780,719, filed on Dec. 17, 2018, provisional application No. 62/609,296, filed on Dec. 21, 2017.

(51) Int. Cl.
| C07K 16/00 | (2006.01) |
| A61P 35/00 | (2006.01) |
| C07K 16/28 | (2006.01) |
| C07K 16/30 | (2006.01) |

(52) U.S. Cl.
CPC .......... *C07K 16/2809* (2013.01); *A61P 35/00* (2018.01); *C07K 16/30* (2013.01); *C07K 2317/54* (2013.01); *C07K 2317/55* (2013.01); *C07K 2317/565* (2013.01); *C07K 2317/622* (2013.01); *C07K 2317/92* (2013.01)

(58) Field of Classification Search
CPC ............... C07K 16/2809; C07K 16/30; C07K 2317/54; C07K 2317/55; C07K 2317/565; C07K 2317/622; C07K 2317/92; A61P 35/00
See application file for complete search history.

(56) References Cited

U.S. PATENT DOCUMENTS

| 7,846,445 B2 | 12/2010 | Schellenberger et al. |
| 7,855,279 B2 | 12/2010 | Schellenberger et al. |
| 8,492,530 B2 | 7/2013 | Schellenberger et al. |
| 8,673,860 B2 | 3/2014 | Schellenberger et al. |
| 8,680,050 B2 | 3/2014 | Schellenberger et al. |
| 8,703,717 B2 | 4/2014 | Schellenberger et al. |
| 8,716,448 B2 | 5/2014 | Schellenberger et al. |
| 8,933,197 B2 | 1/2015 | Stemmer et al. |
| 8,957,021 B2 | 2/2015 | Schellenberger et al. |
| 9,062,299 B2 | 6/2015 | Schellenberger et al. |
| 9,168,312 B2 | 10/2015 | Schellenberger et al. |
| 9,249,211 B2 | 2/2016 | Schellenberger et al. |
| 9,371,369 B2 | 6/2016 | Schellenberger et al. |
| 9,376,672 B2 | 6/2016 | Schellenberger et al. |
| 9,453,078 B2 | 9/2016 | Stagliano et al. |
| 9,540,430 B2 | 1/2017 | Schellenberger et al. |
| 9,758,776 B2 | 9/2017 | Schellenberger et al. |
| 9,849,188 B2 | 12/2017 | Schellenberger et al. |
| 9,926,351 B2 | 3/2018 | Schellenberger et al. |
| 9,938,331 B2 | 4/2018 | Schellenberger et al. |
| 9,976,166 B2 | 5/2018 | Schellenberger et al. |
| 10,000,543 B2 | 6/2018 | Schellenberger et al. |
| 10,172,953 B2 | 1/2019 | Schellenberger et al. |
| 2003/0228309 A1 | 12/2003 | Salcedo et al. |
| 2004/0234609 A1 | 11/2004 | Collier et al. |

(Continued)

FOREIGN PATENT DOCUMENTS

| EP | 2155788 B1 | 6/2012 |
| EP | 2369005 B1 | 4/2013 |

(Continued)

OTHER PUBLICATIONS

Adams, et al. High affinity restricts the localization and tumor penetration of single-chain fv antibody molecules. Cancer Res. 61(12):4750-5 (Jun. 15, 2001).

Adams, et al. Increased affinity leads to improved selective tumor delivery of single-chain Fv antibodies. Cancer Res. 58(3):485-90 (Feb. 1, 1998).

Adams. The development of proteasome inhibitors as anticancer drugs. Cancer Cell 5:417-421 (May 2004).

(Continued)

*Primary Examiner* — Lei Yao

(74) *Attorney, Agent, or Firm* — LATHROP GPM LLP; James H. Velema, Esq.; Michael J. Spellberg

(57) ABSTRACT

The present invention relates to activatable recombinant polypeptide compositions comprising a cleavage release segment. In some instances, the activatable recombinant polypeptide compositions include an XTEN linked to binding moieties by cleavable release segments that, when cleaved, the binding moieties are capable of binding together effector T cells with targeted tumor or cancer cells and effecting cytolysis of the tumor cells or cancer cells. The invention also provides compositions and methods of making and using the cleavable activatable recombinant compositions.

20 Claims, 90 Drawing Sheets

Specification includes a Sequence Listing.

(56) References Cited

U.S. PATENT DOCUMENTS

| | | | |
|---|---|---|---|
| 2011/0046060 | A1 | 2/2011 | Schellenberger et al. |
| 2012/0178691 | A1 | 7/2012 | Schellenberger et al. |
| 2012/0239554 | A1 | 9/2012 | Primbas et al. |
| 2012/0321626 | A1* | 12/2012 | Zhou .................. C07K 14/705 435/417 |
| 2015/0266943 | A1 | 9/2015 | Chhabra et al. |
| 2016/0152707 | A1 | 6/2016 | Kufer et al. |
| 2016/0194339 | A1 | 7/2016 | Chung et al. |
| 2017/0247476 | A1 | 8/2017 | Yan et al. |
| 2018/0057593 | A1 | 3/2018 | Dennis |
| 2018/0125988 | A1* | 5/2018 | Yang .................. A61K 47/6803 |
| 2019/0153115 | A1* | 5/2019 | Schellenberger ...... C07K 16/30 |
| 2021/0054077 | A1* | 2/2021 | Schellenberger .... C07K 16/468 |

FOREIGN PATENT DOCUMENTS

| | | | |
|---|---|---|---|
| EP | 1940881 | B1 | 11/2016 |
| WO | WO-9306844 | A1 | 4/1993 |
| WO | WO-02077036 | A2 | 10/2002 |
| WO | WO-2006081249 | A2 | 8/2006 |
| WO | WO-2007073486 | A2 | 6/2007 |
| WO | WO-2008049931 | A1 | 5/2008 |
| WO | WO-2010091122 | A1 | 8/2010 |
| WO | WO-2010144502 | A2 | 12/2010 |
| WO | WO-2010144508 | A1 | 12/2010 |
| WO | WO-2011028228 | A1 | 3/2011 |
| WO | WO-2011028229 | A1 | 3/2011 |
| WO | WO-2011028344 | A2 | 3/2011 |
| WO | WO-2011084808 | A2 | 7/2011 |
| WO | WO-2011123830 | A2 | 10/2011 |
| WO | WO-2013040093 | A2 | 3/2013 |
| WO | WO-2013122617 | A1 | 8/2013 |
| WO | WO-2013130683 | A2 | 9/2013 |
| WO | WO-2013130684 | A1 | 9/2013 |
| WO | WO-2013184216 | A1 | 12/2013 |
| WO | WO-2014011819 | A2 | 1/2014 |
| WO | WO-2014164568 | A1 | 10/2014 |
| WO | WO-2015023891 | A2 | 2/2015 |
| WO | WO-2016077505 | A2 | 5/2016 |
| WO | WO-2016109823 | A1 | 7/2016 |
| WO | WO2017040344 | * | 3/2017 |
| WO | WO-2017040344 | A2 | 3/2017 |
| WO | WO-2017162587 | A1 | 9/2017 |
| WO | WO-2018022939 | A1 | 2/2018 |
| WO | WO-2019126576 | A1 | 6/2019 |

OTHER PUBLICATIONS

Akagi et al. CA19-9 epitope a possible marker for MUC-1/Y protein. International Journal of Oncology 18:1085-1091 (2001).

Albright et al. Matrix metalloproteinase-activated doxorubicin prodrugs inhibit HT1080 xenograft growth better than doxorubicin with less toxicity. Mol Cancer Ther 4(5):751-760 (May 2005).

Alvarez, et al. Improving Protein Pharmacokinetics by Genetic Fusion to Simple Amino Acid Sequences. J Biol Chem. 2004; 279: 3375-81.

Amann et al. Therapeutic window of an EpCAM/CD3-speciWc BiTE antibody in mice is determined by a subpopulation of EpCAM-expressing lymphocytes that is absent in humans. Cancer Immunol Immunother (2009) 58:95-109. Published online Jul. 2, 2008.

Amler et al. HER2 as a Therapeutic Target in Ovarian Cancer. Ovarian Cancer—Clinical and Therapeutic Perspectives (Feb. 15, 2012). 25 pages. DOI: 10.5772/29064. Available at URL: https://www.intechopen.com/books/ovarian-cancer-clinical-and-therapeutic-perspectives/her2-as-a-ther . . . .

Annex 2: Chou Fasman (1974) and Tepitope analyses of prior art sequences. Opposition dated Aug. 18, 2015 by XL-Protein GmbH against EP2402754 Application No. 11172812.7.

Arcidiacono et al. Expression of matrix metalloproteinase-11 is increased under conditions of insulin resistance. World J Diabetes 8(9):422-428 (Sep. 15, 2017). DOI: 10.4239/wjd.v8.i9.422.

Armstrong. EpCAM: A New Therapeutic Target for an Old Cancer Antigen. Cancer Biology & Therapy 2(4):320-325 (Jul./Aug. 2003).

Arnau, et al. Current strategies for the use of affinity tags and tag removal for the purification of recombinant proteins. Protein Expr Purif. Jul. 2006;48(1):1-13. doi: 10.1016/j.pep.2005.12.002. Epub Dec. 28, 2005.

Asano et al. Highly Effective Recombinant Format of a Humanized IgG-like Bispecific Antibody for Cancer Immunotherapy with Retargeting of Lymphocytes to Tumor Cells. The Journal of Biological Chemistry 282(38):27659-27665 (Sep. 21, 2007).

Au et al. Clinical aspects of drug delivery to tumors. Journal of Controlled Release 78:81-95 (2002).

Ayers et al. IFN-γ-related mRNA profile predicts clinical response to PD-1 blockade. The Journal of Clinical Investigation 127(8):2930-2940 (Aug. 2017).

Bagshawe et al. Antibody directed enzyme prodrug therapy: a pilot-scale clinical trial. Tumor Targeting 1:17-29 (1995).

Bagshawe et al. Antibody Directed Enzyme Prodrug Therapy (ADEPT): Clinical Report. Disease Markers 9:233-238 (1991).

Bagshawe et al. Antibody-directed enzyme prodrug therapy (ADEPT) for cancer. Expert Opin Biol Ther 4(11):1777-1789 (2004).

Baldus et al. Coexpression of MUC1 Mucin Peptide Core and the Thomsen-Friedenreich Antigen in Colorectal Neoplasms. Cancer 82(6):1019-1027 (Mar. 15, 1998).

Balzar et al. The Structural Analysis of Adhesions Mediated by Ep-CAM. Experimental Cell Research 246:108-121 (1999).

Banerjee et al. Poly(ethylene glycol)-Prodrug Conjugates: Concept, Design, and Applications. vol. 2012, Article ID 103973 (2012). 17 pages. doi:10.1155/2012/103973.

Bargou et al. Tumor Regression in Cancer Patients by Very Low Doses of a T Cell Engaging Antibody. Science 321:974-977 (Aug. 15, 2008). DOI: 10.1126/science. 1158545.

Barok et al. Trastuzumab-DM1 is highly effective in preclinical models of HER2-positive gastric cancer. Cancer Letters 306:171-179 (2011).

Baxter et al. Pharmacokinetic analysis of the microscopic distribution of enzyme-conjugated antibodies and prodrugs: comparison with experimental data. British Journal of Cancer 73:447-456 (1996).

Belimezi et al. Growth inhibition of breast cancer cell lines overexpressing Her2/neu by a novel internalized fully human Fab antibody fragment. Cancer Immunol Immunother 55:1091-1099 (2006). Published online Nov. 26, 2005.

Bell, et al. "Differential tumor-targeting abilities of three single-domain antibody formats." Cancer Letters 289:81-90 (Mar. 1, 2010). Epub Aug. 28, 2009. doi: 10.1016/j.canlet.2009.08.003.

Bellone et al. Solitomab, an EpCAM/CD3 bispecific antibody construct(BiTE), is highly active against primary uterine serous papillary carcinoma cell lines in vitro. American Journal of Obstetrics & Gynecology p. 99.e2-99.e8 (Jan. 2016).

Berek et al. Catumaxomab for the Treatment of Malignant Ascites in Patients With Chemotherapy-Refractory Ovarian Cancer. Int J Gynecol Cancer 24(9):1583-1589 (Nov. 2014).

Bhowmick, et al. Stromal fibroblasts in cancer initiation and progression. Nature. Nov. 18, 2004;432(7015):332-337. doi: 10.1038/nature03096.

Biggers et al. VB4-845, a conjugated recombinant antibody and immunotoxin for head and neck cancer and bladder cancer. Current Opinion in Molecular Therapeutics 10(2):176-186 (2008).

Birkedal-Hansen et al. Matrix Metalloproteinases: A Review. Critical Reviews in Oral Biology & Medicine 4(2):197-250 (1993).

BLINCYTO Package Insert. AMGEN. Issued Dec. 2014.

Borsi et al. Selective targeting of tumoral vasculature: Comparison of different formats of an antibody (L19) to the ED-B domain of fibronectin. Int J Cancer 102:75-85 (2002).

Boustany et al. EGFR-CD3 Bispecific Probody™ Therapeutic Induces Tumor Regressions and Increases Maximum Tolerated Dose 60 fold in Preclinical Studies. Poster. CytomX Therapeutics. Copyright 2017.

Boyd et al. PoPS: A Computational Tool for Modeling and Predicting Protease Specificity. Journal of Bioinformatics and Computational Biology 3(3):551-585 (2005).

(56) References Cited

OTHER PUBLICATIONS

Brand et al. Treatment of Colorectal Liver Metastases by Adenoviral Transfer of Tissue Inhibitor of Metalloproteinases-2 into the Liver Tissue. Cancer Research 60:5723-5730 (Oct. 15, 2000).
Bremer et al. In vivo molecular target assessment of matrix metalloproteinase inhibition. Nature Medicine 7(6):743-748 (Jun. 2001).
Brischwein et al. MT110: A novel bispecific single-chain antibody construct with high efficacy in eradicating established tumors. Molecular Immunology 43:1129-1143 (2006). Available online Sep. 1, 2005.
Buache et al. Functional relationship between matrixmetalloproteinase-11 and matrix metalloproteinase-14. Cancer Medicine 3(5):1197-1210 (2014). doi: 10.1002/cam4.290.
Burges et al. Effective Relief of Malignant Ascites in Patients with Advanced Ovarian Cancer by a Trifunctional Anti-EpCAM Anti-CD3 Antibody: A Phase I/II Study. Clin Cancer Res 13(13):3899-3905 (Jul. 1, 2017).
Buscaglia, et al. Tandem amino acid repeats from Trypanosoma cruzi shed antigens increase the half-life of proteins in blood. Blood. Mar. 15, 1999;93(6):2025-32.
Byrne et al. A tale of two specificities: bispecific antibodies for therapeutic and diagnostic applications. Trends in Biotechnology 31(11):621-632 (Nov. 2013).
Cai, et al. Developments in human growth hormone preparations: sustained-release, prolonged half-life, novel injection devices, and alternative delivery routes. Int J Nanomedicine. 2014; 9:3527-3538. Published online Jul. 25, 2014. doi: 10.2147/IJN.S63507.
Cal and Obaya, eds. Proteases and Cancer: Methods and Protocols. Humana Press. Copyright 2018. DOI: https://doi.org/10.1007/978-1-4939-7595-2.
Cao et al. Multiformat T-Cell-Engaging Bispecific Antibodies Targeting Human Breast Cancers. Angew Chem Int Ed 54:7022-7027 (2015). DOI: 10.1002/anie.201500799.
Cell Therapeutics Press Release. Cell Therapeutics Inc.'s Polyglutamate (PG) Technology Highlighted at International Polymer Therapeutics Meeting; Novel Recombinant Technology Extends PG Platform to G-CSF. Jan. 4, 2002. PR Newswire. Opposition by XL-Protein GmbH against EP2402754 Application No. 11172812.7.
Cesano et al. CD22 as a Target of Passive Immunotherapy. Seminars in Oncology 30(2):253-257 (Apr. 2003).
Cheadle. MT-103 Micromet/MedImmune. Current Opinion in Molecular Therapeutics 8(1):62-68 (2006).
Chen et al. A Unique Substrate Recognition Profile for MatrixMetalloproteinase-2. The Journal of Biological Chemistry 277(6):4485-4491 (Feb. 8, 2002). Published, JBC Papers in Press, Nov. 2, 2001, DOI 10.1074/jbc.M109469200.
Cheng et al. Successful engineering of a highly potent single-chain variable-fragment (scFv) bispecific antibody to target disialoganglioside (GD2) positive tumors. Oncoimmunology 5(6):e1168557 (2016). 9 pages.
Chhieng et al. Expression of CEA, Tag-72, and Lewis-Y Antigen in Primary and Metastatic Lesions of Ovarian Carcinoma, pp. 1016-1021. Presented in part at the 93rd annual meeting of American Association of Cancer Research, San Francisco, CA, Apr. 6-10, 2002, and the 10th annual Specialized Program of Research Excellence (SPORE) meeting, Chantilly, VA, Jul. 13-16, 2002.
Choi et al. Bispecific antibodies engage T cells for antitumor immunotherapy. Expert Opin. Biol. Ther. [Early Online]. Copyright 2011 Informa UK, Ltd. DOI: 10.1517/14712598.2011.572874. 11 pages.
Chou, et al. Prediction of Protein Conformation. Biochemistry. Jan. 15, 1974;13(2):222-245. doi: 10.1021/bi00699a002.
Chou; et al., Prediction of the Secondary Structure of Proteins from Their Amino Acid Sequence, from Advances in Enzymology vol. 47, John Wiley and Sons. Published 1978, p. 60.
Clapper et al. Detection of Colorectal Adenomas Using a Bioactivatable Probe Specific for Matrix Metalloproteinase Activity. Neoplasia 13(8):685-691 (Aug. 2011).

Cleland, et al. A novel long-acting human growth hormone fusion protein (VRS-317): enhanced in vivo potency and half-life. J Pharm Sci. Aug. 2012;101(8):2744-54. doi:10.1002/jps.23229. Epub Jun. 7, 2012.
Cramer et al. Conditions Associated with Antibodies Against the Tumor-Associated Antigen MUC1 and Their Relationship to Risk for Ovarian Cancer. Cancer Epidemiology, Biomarkers & Prevention 14(5):1125-1131 (May 2005).
Cretney et al. Cancer: Novel therapeutic strategies that exploit the TNF-related apoptosis-inducing ligand (TRAIL)/TRAIL receptor pathway. The International Journal of Biochemistry & Cell Biology 39280-286 (2007). Available online Oct. 7, 2006.
Croce et al. Expression of Tumour Associated Antigens in Normal, Benign and Malignant Human Mammary Epithelial Tissue: A Comparative Immunohistochemical Study. Anticancer Research 17:4287-7292 (1997).
Dahlberg et al. The Lymphatic System Plays a Major Role in the Intravenous and Subcutaneous Pharmacokinetics of Trastuzumab in Rats. Mol Pharmaceutics 11:496-504 (Dec. 18, 2013). DOI: dx.doi.org/10.1021/mp400464s.
Danhier et al. To exploit the tumor microenvironment: Passive and active tumor targeting of nanocarriers for anti-cancer drug delivery. Journal of Controlled Release 148:135-146 (2010). Available online Aug. 24, 2010.
Davol et al. Anti-CD3 × Anti-HER2 Bispecific Antibody Effectively Redirects Armed T Cells to Inhibit Tumor Development and Growth in Hormone-Refractory Prostate Cancer-Bearing Severe Combined Immunodeficient Beige Mice. Clinical Prostate Cancer 3(2): 112-121 (Sep. 2004).
De Goeij et al. HER2 monoclonal antibodies that do not interfere with receptor heterodimerization-mediated signaling induce effective internalization and represent valuable components for rational antibody-drug conjugate design. mAbs 6(2):392-402 (Mar./Apr. 2014). Published online Jan. 3, 2014. DOI: 10.4161/mabs.27705.
De Lorenzo et al. Biological properties of a human compact anti-ErbB2 antibody. Carcinogenesis 26(11):1890-1895 (2005). Advance access publication Jun. 1, 2005. doi:10.1093/carcin/bgi146.
De Lorenzo et al. Intracellular route and mechanism of action of ERB-hRNase, a human anti-ErbB2 anticancer immunoagent. FEBS Letters 581:296-300 (2007). Available online Jan. 2, 2007.
De Vega et al. Multimodal laser ablation/desorption imaging analysis of Zn and MMP-11 in breast tissues. Anal Bioanal Chem 410:913-922 (2018). Published online Aug. 12, 2017. DOI 10.1007/s00216-017-0537-x.
Decision revoking the European Patent dated Mar. 16, 2016 for EP1996220 Application No. 07752636.6.
Decision revoking the European Patent dated May 9, 2017 for EP2402754 Application No. 11172812.7.
Denton et al. Primary Sequence Determination and Molecular Modelling of the Variable Region of an AntiMUC1 Mucin Monoclonal Antibody. European Journal of Cancer 31A(2):214-221 (1995).
Deppisch et al. Efficacy and Tolerability of a GD2-Directed Trifunctional Bispecific Antibody in a Preclinical Model: Subcutaneous Administration Is Superior to Intravenous Delivery. Mol Cancer Ther 14(8):1877-1883 (Aug. 2015).
Desnoyers et al. Supplementary Materials for Tumor-Specific Activation of an EGFR-Targeting Probody Enhances Therapeutic Index. Sci Transl Med 5:207ra144 (Oct. 16, 2013). 14 pages. DOI: 10.1126/scitranslmed.3006682.
Desnoyers et al. Tumor-Specific Activation of an EGFR-Targeting Probody Enhances Therapeutic Index. Science Translational Medicine 5(207):207ra144 (Oct. 16, 2013). 12 pages.
Devy et al. Selective Inhibition of Matrix Metalloproteinase-14 Blocks Tumor Growth, Invasion, and Angiogenesis. Cancer Res 69(4):1517-1526 (Feb. 15, 2009). Published online Feb. 10, 2009. DOI: 10.1158/0008-5472.CAN-08-3255.
Di Paolo et al. A Recombinant Immunotoxin Derived from a Humanized Epithelial Cell Adhesion Molecule-specific Single-Chain Antibody Fragment Has Potent and Selective Antitumor Activity. Clinical Cancer Research 9:2837-2848 (Jul. 2003).

(56) References Cited

OTHER PUBLICATIONS

Ding, et al. Multivalent Antiviral XTEN-Peptide Conjugates with Long in Vivo Half-Life and Enhanced Solubility. Bioconjug Chem. Jul. 16, 2014;25(7):1351-1359. doi: 10.1021/bc500215m. Epub Jun. 23, 2014.

Donaldson, J. M. et al., Design and development of masked therapeutic antibodies to limit off-target effects: application to anti-EGFR antibodies. Cancer Biology & Therapy 8(22):2147-2152 (Nov. 2009).

Dorvillius et al. Targeting of Human Breast Cancer by a Bispecific Antibody Directed against Two Tumour-Associated Antigens: ErbB-2 and Carcinoembryonic Antigen. Tumor Biol 23:337-347 (2002). DOI: 10.1159/000069793.

Duffy et al. uPA and PAI-1 as biomarkers in breast cancer: validated for clinical use in level-of-evidence-1 studies. Breast Cancer Research 16:428 (2014). 10 pages.

Endo-Munoz et al. Progression of Osteosarcoma from a Non-Metastatic to a Metastatic Phenotype Is Causally Associated with Activation of an Autocrine and Paracrine uPA Axis. PLOS ONE (Aug. 28, 2015). 22 pages. DOI:10.1371/journal.pone.0133592.

Feldmann et al. Novel Humanized and Highly Efficient Bispecific Antibodies Mediate Killing of Prostate Stem Cell Antigen-Expressing Tumor Cells by CD8+ and CD4+ T Cells. The Journal of Immunology 189:3249-3259 (2012).

Fernandez-Garcia et al. Expression and prognostic significance of fibronectin and matrix metalloproteases in breast cancer metastasis. Histopathology 64:512-522 (2014). DOI: 10.1111/his.12300.

Filpula. Releasable PEGylation of Mesothelin Targeted Immunotoxin SS1P Achieves Single Dosage Complete Regression of a Human Carcinoma in Mice. Bioconjugate Chem 18:773-784 (2007). Published online Mar. 9, 2007. DOI: 10.1021/bc060314x.

Fortmüller et al. Effective Targeting of Prostate Cancer by Lymphocytes Redirected by a PSMA CD3 Bispecific Single-Chain Diabody. The Prostate 71:588-596 (2011).

Fousek et al. The Evolution of T-cell Therapies for Solid Malignancies. Clin Cancer Res 21(15)3384-3392 (Aug. 1, 2015).

Friberg et al. Blinatumomab (Blincyto®); lessons learned from the bispecific t-cell engager (BITE®) in acute lymphocytic leukemia (ALL). © The Author 2017. Published by Oxford University Press on behalf of the European Society for Medical Oncology. 8 pages.

Garber. Bispecific antibodies rise again. Nature Reviews—Drug Discovery, vol. 14, pp. 799-801 (Nov. 2014).

Garnier, et al. GOR method for predicting protein secondary structure from amino acid sequence. Methods Enzymol. 1996;266:540-553. doi: 10.1016/s0076-6879(96)66034-0.

Geething, et al. Gcg-XTEN: an improved glucagon capable of preventing hypoglycemia without increasing baseline blood glucose. PLoS One. Apr. 14, 2010;5(4):e10175. doi: 10.1371/journal.pone.0010175.

Germain et al. Redirecting NK cells mediated tumor cell lysis by a new recombinant bifunctional protein. Protein Engineering, Design & Selection 21(11):665-672 (2008). Published online Sep. 11, 2008. doi:10.1093/protein/gzn047.

Graves et al. Proinvasive Properties of Ovarian Cancer Ascites-Derived Membrane Vesicles. Cancer Research 64:7045-7049 (Oct. 1, 2004).

Haense et al. A phase I trial of the trifunctional anti Her2 × anti CD3 antibody ertumaxomab in patients with advanced solid tumors. BMC Cancer 16:420 (2016). 10 pages. DOI 10.1186/s12885-016-2449-0.

Herbst. Review of Epidermal Growth Factor Receptor Biology. Int J Radiation Oncology Biol Phys vol. 59, No. 2, Supplement, pp. 21-26 (2004). doi:10.1016/j.ijrobp.2003.11.041.

Hinrichs et al. Reassessing target antigens for adoptive T-cell therapy. Nature Biotechnology 31(11):999-1008 (Nov. 2013).

Hoffmann et al. Serial killing of tumor cells by cytotoxic T cells redirected with a CD19-/CD3-bispecific single-chain antibody construct. Int J Cancer 115:98-104 (2005). Published online Feb. 1, 2005. DOI 10.1002/ijc.20908.

Hopp, et al. Prediction of protein antigenic determinants from amino acid sequences. Proc Natl Acad Sci USA. Jun. 1981;78(6):3824-3828. doi: 10.1073/pnas.78.6.3824.

Hsin et al. MMP-11 promoted the oral cancer migration and FAK/Src activation. Oncotarget 8(20):32783-32793 (Mar. 2, 2017).

Iniesta et al. Biological and clinical significance of MMP-2, MMP-9, TIMP-1 and TIMP-2 in non-small cell lung cancer. Oncology Reports 17:217-223 (2007).

International search report with written opinion dated May 9, 2019 for PCT/US2018/066939.

Internet printout for Chou Fasman algorithm, 1974. Available at http://www.biogem.org/tool/chou-fasman. Opposition by XL-Protein GmbH against EP2402754 Application No. 11172812.7.

Ishiguro et al. An anti-glypican 3/CD3 bispecific T cell-redirecting antibody for treatment of solid tumors. Sci Transl Med 9:eaal4291 (Oct. 4, 2017). 13 pages. DOI: 10.1126/scitranslmed.aal4291.

Ishiguro et al. Supplementary Materials for An anti-glypican 3/CD3 bispecific T cell-redirecting antibody for treatment of solid tumors. Sci Transl Med 9:eaal4291 (Oct. 4, 2017). 25 pages. DOI: 10.1126/scitranslmed.aal4291.

James et al. Biophysical Mechanism of T Cell Receptor Triggering in a Reconstituted System. Nature 487(7405):64-69 (Jul. 5, 2012).

Jäger et al. Immunomonitoring Results of a Phase II/III Study of Malignant Ascites Patients Treated with the Trifunctional Antibody Catumaxomab (Anti-EpCAM Anti-CD3). Cancer Res 72(1):24-32 (Jan. 1, 2012). Published online Nov. 1, 2011. DOI: 10.1158/0008-5472.CAN-11-2235.

Jin et al. MetMAb, the one-armed 5D5 anti-c-met antibody, inhibits orthotopic pancreatic tumor growth and improves survival. Cancer Res 68(11):4360-4368 (Jun. 1, 2008).

Junttila et al. Antitumor Efficacy of a Bispecific Antibody That Targets HER2 and Activates T Cells. Cancer Res 74(19):5561-5571 (2014). doi: 10.1158/0008-5472.CAN-13-3622-T.

Klinger. BiTE® Antibody Constructs Beyond Blinatumomab: Overview of Amgen's Early-Stage BiTE® Pipeline (slides). CHI's 6th Annual Immuno-Oncology Summit (Aug. 27-31, 2018).

Koblinski, et al. Unraveling the role of proteases in cancer. Clin Chim Acta. Feb. 15, 2000;291(2):113-35.

Kridel et al. Substrate Hydrolysis by Matrix Metalloproteinase-9. J Biol Chem 276(23):20572-20578 (Jun. 8, 2001). Published, JBC Papers in Press, Mar. 14, 2001, DOI 10.1074/jbc.M100900200.

Lafky et al. Clinical implications of the ErbB/epidermal growth factor (EGF) receptor family and its ligands in ovarian cancer. Biochimica et Biophysica Acta 1785:232-265 (2008). Available online Feb. 7, 2008.

Lameris et al. Bispecific antibody platforms for cancer immunotherapy. Critical Reviews in Oncology/Hematology 92:153-165 (2014).

Lee, et al. Current concepts in the diagnosis and management of cytokine release syndrome. Blood. Jul. 10, 2014;124(2):188-95. doi: 10.1182/blood-2014-05-552729. Epub May 29, 2014.

Lee, et al. Increased expression of matriptase is associated with histopathologic grades of cervical neoplasia. Hum Pathol. Jun. 2005;36(6):626-633. doi: 10.1016/j.humpath.2005.03.003.

Leong et al. An anti-CD3/anti-CLL-1 bispecific antibody for the treatment of acute myeloid leukemia. Blood 129(5):609-618 (2017). Published online Dec. 1, 2016. doi:10.1182/blood-2016-08-735365.

Levitt, M. A simplified representation of protein conformations for rapid simulation of protein folding. Journal of Molecular Biology. Jun. 1976; 104(1): 59-107.

Li et al. A Novel Bispecific Antibody, S-Fab, Induces Potent Cancer Cell Killing. J Immunother 38(9):350-356 (Nov./Dec. 2015).

Li et al. IFN-γ-induced chemokines are required for CXCR3-mediated T cell recruitment and anti-tumor efficacy of anti-HER2/CD3 bispecific antibody. Author Manuscript Published Online First on Jun. 27, 2018. 29 pages. Doi: 10.1158/1078-0432.CCR-18-1139.

Li et al. Prognostic Value of MMP-9 in Ovarian Cancer: A Meta-analysis. Asian Pacific Journal of Cancer Prevention 14:4107-4113 (2013). DOI: http://dx.doi.org/10.7314/APJCP.2013.14.7.4107.

Liu, et al. Overexpression of legumain in tumors is significant for invasion/metastasis and a candidate enzymatic target for prodrug therapy. Cancer Res. Jun. 1, 2003;63(11):2957-2964.

(56) References Cited

OTHER PUBLICATIONS

Lum et al. Targeted T cell Therapy in Stage IV Breast Cancer: A Phase I Clinical Trial. Clin Cancer Res. Author Manuscript Published Online First on Feb. 16, 2015. 28 pages. DOI: 10.1158/1078-0432.CCR-14-2280.
Mathieu et al. Substrate specificity of schistosome versus human legumain determined by P1-P3 peptide libraries. Molecular & Biochemical Parasitology 121:99-105 (2002).
Mau-SØrensen et al. A phase I trial of intravenous catumaxomab: a bispecific monoclonal antibody targeting EpCAM and the T cell coreceptor CD3. Cancer Chemother Pharmacol 75:1065-1073 (2015). Published online Mar. 27, 2015. DOI 10.1007/s00280-015-2728-5.
McGowan et al. Matrix metalloproteinase expression and outcome in patients with breast cancer: analysis of a published database. Annals of Oncology 19:1566-1572 (2008). Published online May 23, 2008. doi: 10.1093/annonc/mdn180.
Mehvar R. Modulation of the pharmacokinetics and pharmacodynamics of proteins by polyethylene glycol conjugation. J. Pharm Pharm Sci. 2000;3(1):125-136.
Meijer et al. Non FcR-binding murine antihuman CD3 monoclonal antibody is capable of productive TCR signalling and induces proliferation in the presence of costimulation. Clin Exp Immunol 123:511-519 (2001).
Melero et al. T-Cell and NK-Cell Infiltration into Solid Tumors: A Key Limiting Factor for Efficacious Cancer Immunotherapy. Cancer Discov 4(5):522-526 (May 2014). doi:10.1158/2159-8290.CD-13-0985.
Miller et al. Design, Construction, and In Vitro Analyses of Multivalent Antibodies. The Journal of Immunology 170:4854-4861 (2003).
Morgia et al. Matrix metalloproteinases as diagnostic (MMP-13) and prognostic (MMP-2, MMP-9) markers of prostate cancer. Urol Res 33:44-50 (2005). Published online Oct. 22, 2004. DOI 10.1007/s00240-004-0440-8.
Myers et al. Lewis Y Antigen as Detected by the Monoclonal Antibody BR96 is Expressed Strongly in Prostatic Adenocarcinoma. The Journal of Urology 153:1572-1574 (May 1995).
Nagase et al. Substrate specificities and activation mechanisms of matrix metalloproteinases. Biochemical Society Transactions 19:715-718 (1991).
Nam et al. Robust Therapeutic Efficacy of Matrix Metalloproteinase-2-Cleavable Fas-1-RGD Peptide Complex in Chronic Inflammatory Arthritis. PLoS ONE 11(10): e0164102 (Oct. 14, 2016). 18 pages. doi:10.1371/journal.pone.0164102.
Notice of opposition dated Feb. 13, 2014 by Novo Nordisk filed Feb. 7, 2014 against EP1996220 Application No. 07752636.6.
Notice of opposition dated Feb. 17, 2014 by XL-protein GmbH filed Feb. 7, 2014 against EP1996220 Application No. 07752636.6.
Notice of opposition dated Aug. 18, 2015 by Novo Nordisk filed Aug. 13, 2015 against EP2402754 Application No. 11172812.7.
Notice of opposition dated Aug. 21, 2015 by XL-protein GmbH filed Aug. 18, 2015 against EP2402754 Application No. 11172812.7.
Oberst et al. CEA/CD3 bispecific antibody MEDI-565/AMG 211 activation of T cells and subsequent killing of human tumors is independent of mutations commonly found in colorectal adenocarcinomas. mAbs 6(6):1571-1584 (Nov./Dec. 2014).
Oberst et al. Expression of the Serine Protease Matriptase and Its Inhibitor HAI1 in Epithelial Ovarian Cancer: Correlation with Clinical Outcome and Tumor Clinicopathological Parameters. Clinical Cancer Research 8:1101-1107 (Apr. 2002).
Offner et al. Induction of regular cytolytic T cell synapses by bispecific single-chain antibody constructs on MHC class I-negative tumor cells. Molecular Immunology 43:763-771 (2006). Available online Apr. 26, 2005. doi: 10.1016/j.molimm.2005.03.007.
Omidfar et al. Production of a novel camel single-domain antibody specific for the type III mutant EGFR. Tumor Biol 25(5-6):296-305 (Sep.-Dec. 2004). DOI: 10.1159/000081395.
Pan et al. Identification of Peptide Substrates for Human MMP-11 (Stromelysin-3) Using Phage Display. J Biol Chem 278(30):27820-27827 (Jul. 25, 2003). Published, JBC Papers in Press, May 8, 2003, DOI 10.1074/jbc.M304436200.
Pei et al. Hydrolytic Inactivation of a Breast Carcinoma Cell-derived Serpin by Human Stromelysin-3. J Biol Chem 269 (41):25849-25855 (Oct. 14, 1994).
Pessano et al. The T3/T cell receptor complex: antigenic distinction between the two 20-kd T3 (T3-delta and T3-epsilon) subunits. The EMBO Journal 4(2):337-344 (1985).
Podust, et al. Extension of in vivo half-life of biologically active molecules by XTEN protein polymers. J Control Release. Oct. 28, 2016;240:52-66. doi: 10.1016/j.jconrel.2015.10.038. Epub Oct. 30, 2015.
Podust, et al. Extension of in vivo half-life of biologically active peptides via chemical conjugation to XTEN protein polymer. Protein Eng Des Sel.Nov. 2013;26(11):743-753.doi: 10.1093/protein/gzt048. Epub Oct. 16, 2013.
Ranuncolo et al. Plasma MMP-9 (92 kDa-MMP) Activity is Useful in the Follow-Up and in the Assessment of Prognosis in Breast Cancer Patients. Int J Cancer 106:745-751 (2003). DOI 10.1002/ijc.11288.
Ross et al. Bispecific T cell engager (BiTE®) antibody constructs can mediate bystander tumor cell killing. PLoS ONE 12(8): e0183390 (Aug. 24, 2017). https://doi.org/10.1371/journal.pone.0183390.
Rossi et al. A new class of bispecific antibodies to redirect T cells for cancer immunotherapy. mabs 6(2):381-391; Mar./Apr. 2014.
Rossi et al. Redirected T-Cell Killing of Solid Cancers Targeted with an Anti-CD3/Trop-2 Bispecific Antibody is Enhanced in Combination with Interferon-α. American Association for Cancer Research. Author Manuscript Published Online First on Jul. 22, 2014; DOI: 10.1158/1535-7163.MCT-14-0345. 34 pages.
Rossi et al. Differential antibody binding to the surface αßTCR•CD3 complex of CD4+ and CD8+ T lymphocytes is conserved in mammals and associated with differential glycosylation. International Immunology 20(10):1247-1258 (Oct. 2008). Advance Access publication Jul. 24, 2008. DOI: https://doi.org/10.1093/intimm/dxn081.
Ruiz et al. p95HER2-T cell bispecific antibody for breast cancer treatment. Sci Transl Med 10:eaat1445 (Oct. 3, 2008). 12 pages.
Sandersjóóet al. A new prodrug form of Affibody molecules (pro-Affibody) is selectively activated by cancer-associated proteases. Cell. Mol. Life Sci. 72:1405-1415 (2015). Published online Oct. 7, 2014. DOI 10.1007/s00018-014-1751-8.
Savariar et al. Real-time In Vivo Molecular Detection of Primary Tumors and Metastases with Ratiometric Activatable Cell-Penetrating Peptides. Cancer Research 73(2):855-864 (2012). Published Online First Nov. 27, 2012; DOI: 10.1158/0008-5472.CAN-12-2969.
Schellenberger, et al. A recombinant polypeptide extends the in vivo half-life of peptides and proteins in a tunable manner. Nat Biotechnol. Dec. 2009;27(12):1186-1190. 2 pages of online methods. Epub Nov. 15, 2009. DOI: 10.1038/nb.1588.
Schellenberger, et al. Online Supplementary material: A recombinant polypeptide extends the in vivo half-life of peptides and proteins in a tunable manner. Nat Biotechnol. Dec. 2009;27(12):1186-1190. 2 pages of online methods. Epub Nov. 15, 2009. DOI: 10.1038/nb.1588. 19 pages of supplementary material.
Schellenberger, V. Engineering of Microproteins for Pharmaceutical Applications. PowerPoint Presentation. (2006). Opposition by XL-Protein GmbH against EP2402754 Application No. 11172812.7.
Scheuer et al. Strongly Enhanced Antitumor Activity of Trastuzumab and Pertuzumab Combination Treatment on HER2-Positive Human Xenograft Tumor Models. Cancer Res 69(24):9330-9336 (Dec. 15, 2009).
Schlereth et al. Potent inhibition of local and disseminated tumor growth in immunocompetent mouse models by a bispecific antibody construct specific for Murine CD3. Cancer Immunol Immunother 55: 785-796 (2006). Published online Sep. 27, 2005. DOI 10.1007/s00262-005-0082-x.
Schlereth et al. T-cell activation and B-cell depletion in chimpanzees treated with a bispecific anti-CD19/anti-CD3 single-chain

(56) References Cited

OTHER PUBLICATIONS antibody construct. Cancer Immunol Immunother 55: 503-514 (2006). Published online Jul. 20, 2005. DOI 10.1007/s00262-005-0001-1.

Schmalfeldt et al. Increased Expression of Matrix Metalloproteinases (MMP)-2, MMP9, and the Urokinase-Type Plasminogen Activator Is Associated with Progression from Benign to Advanced Ovarian Cancer. Clinical Cancer Research 7:2396-2404 (Aug. 2001).

Senter et al. Selective activation of anticancer prodrugs by monoclonal antibody-enzyme conjugates. Advanced Drug Delivery Reviews 53:247-264 (2001).

Shekhar. Double Whammy: Bispecific Antibodies Help Immune Cells Attack Tumors. Chemistry & Biology, vol. 15 (Sep. 22, 2008). 2 pages. DOI 10.1016/j.chembiol.2008.09.002.

Sier et al. Tissue levels of matrix metalloproteinases MMP-2 and MMP-9 are related to the overall survival of patients with gastric carcinoma. British Journal of Cancer 74:413-417 (1996).

Slaga et al. Avidity-based binding to HER2 results in selective killing of HER2-overexpressing cells by anti-HER2/CD3. Sci Transl Med 10:eaat5775 (Oct. 17, 2018). 11 pages.

Squire, P.G. Calculation of hydrodynamic parameters of random coil polymers from size exclusion chromatography and comparison with parameters by conventional methods. Journal of Chromatography A. Jun. 19, 1981. 210(3):433-442. https://doi.org/10.1016/S0021-9673(00)80335-0.

Stamova et al. Simultaneous engagement of the activatory receptors NKG2D and CD3 for retargeting of effector cells to CD33-positive malignant cells. Leukemia 25:1053-1056 (2011). Published online Mar. 18, 2011. doi: 10.1038/leu.2011.42.

Stone et al. A sensitivity scale for targeting T cells with chimeric antigen receptors (CARs) and bispecific T-cell engagers (BiTEs). OncoImmunology 1(6):863-873 (Sep. 2012). http://dx.doi.org/10.4161/onci.20592.

Sturniolo, et al. Generation of tissue-specific and promiscuous HLA ligand databases using DNA microarrays and virtual HLA class II matrices. Nat Biotechnol. Jun. 1999;17(6):555-61. doi:10.1038/9858.

Sun, et al. Anti-CD20/CD3 T cell-dependent bispecific antibody for the treatment of B cell malignancies. Sci Transl Med. May 136, 2015;7(287):287ra70. 11 pages. doi: 10.1126/scitranslmed.aaa4802.

Taberno et al. Phase I studies of the novel carcinoembryonic antigen CD3 T-cell bispecific (CEA-TCB) antibody as a single agent and in combination with atezolizumab: preliminary efficacy and safety in patients with metastatic colorectal cancer (mCRC). Slides. 2017 American Society of Clinical Oncology (ASCO) Annual Meeting, Jun. 2-5, 2017. 19 pages.

Tanford, et al. Proteins in 6 M guanidine hydrochloride. Demonstration of random coil behavior. J Biol Chem. Apr. 25, 1966;241(8):1921-1923.

Tanimoto, et al. Transmembrane serine protease TADG-15 (ST14/Matriptase/MT-SP1): expression and prognostic value in ovarian cancer. Br J Cancer. Jan. 31, 2005; 92(2): 278-283. Published online Dec. 21, 2004. doi: 10.1038/sj.bjc.6602320.

Tepitope analysis for SAPA repeats of opposition cited reference D5 Buscaglia et al. (1999) Blood 93:2025-2032 by Novo Nordisk against EP2402754 Application No. 11172812.7.

The Chou-Fasman tool was provided by William R. Pearson and the University of Virginia, at the "Biosupport" internet site, URL located on the World Wide Web at .fasta.bioch.virginia.edu/fasta_www2/fasta_www.cgi?rm=misc1 as it existed on Jun. 19, 2009.

The GOR tool was provided by Pole Informatique Lyonnais at the Network Protein Sequence Analysis internet site, URL located on the World Wide Web at .npsa-pbil.ibcp.fr/cgi-bin/secpred_gor4.pl as it existed on Jun. 19, 2008.

Tian, et al. Expression of CD147 and matrix metalloproteinase-11 in colorectal cancer and their relationship to clinicopathological features. J Transl Med. 2015; 13: 337. 11 pages.

Van Nagell, Jr et al. The Clinical Significance of Carcinoembryonic Antigen in the Plasma and Tumors of Patients with Gynecologic Malignancies. Cancer 42:1527-1532 (1978).

Van Zoelen, et al. The use of nonhomologous Scatchard analysis in the evaluation of ligand-protein interactions. Trends Pharmacol Sci. Dec. 1998;19(12):487-490. doi: 10.1016/s0165-6147(98)01250-4.

Walsh G. Appendix 1—Biopharmaceuticals thus far approved in the USA or European Union. Biopharmaceuticals: Biochemistry and Biotechnology. Second Edition. John Wiley & Sons. Published 2003. West Sussex, England. ISBN 0 470 84327 6 (pbk). 25 pages.

Yuen, et al., A long-acting human growth hormone with delayed clearance (VRS-317): results of a double-blind, placebo-controlled, single ascending dose study in growth hormone-deficient adults. J Clin Endocrinol Metab. Jun. 2013, 98(6), 2595-2603.

\* cited by examiner

| Symbol | Name | Description |
|---|---|---|
| ECA | Effector Cell Antigen | An antigen (receptor) on the surface of an Effector Cell |
| ECBM | Effector Cell Binding Moiety | Binding Moiety (protein domain, peptide, synthetic ligand) that binds specifically to the Effector Cell Antigen |
| Effector Cell (with ECA) | Effector Cell | A cell that is capable of killing or inhibiting at tumor cell or a cell that is part of tumor tissue. Effector Cells can be T-cells, NK cells. |
| TA | Tumor Antigen | An antigen (receptor) that is overexpressed on cells that from a tumor. |
| TABM | Tumor Antigen Binding Moiety | A binding moiety (protein domain, peptide, synthetic ligand) that binds specifically to a tumor antigen. |
| Tumor Associated Cell (with TA) | Tumor Associated Cell | A cell that is part of a tumor. This can be a tumor cell or other cell types such as stroma that form a tumor mass. |
| Bulking Moiety | Bulking Moiety | Bulking Moiety is a protein or polymer that has a larger size than the ECBM and the TABM. The BD can be albumin, an albumin binding domain, Fc, PEG, XTEN |
| XTEN | | |
| RS | Release Site | Release Site is an amino acid sequence that can be cleaved by a tumor associated protease. |
| ✂ | Tumor Associated Protease | Tumor Associated Protease is an proteolytic enzyme that occurs in the extracellular space of tumor tissue. |
| | ProTIA | Protease Triggered Immune Activator |
| | ProTIA in pro-form | ProTIA molecule prior to protease-catalyzed trigger event |
| | ProTIA in apo-form | ProTIA molecule that has lost its bulking domain due to a protease-catalyzed trigger event |

FIG. 1

FIG. 3A
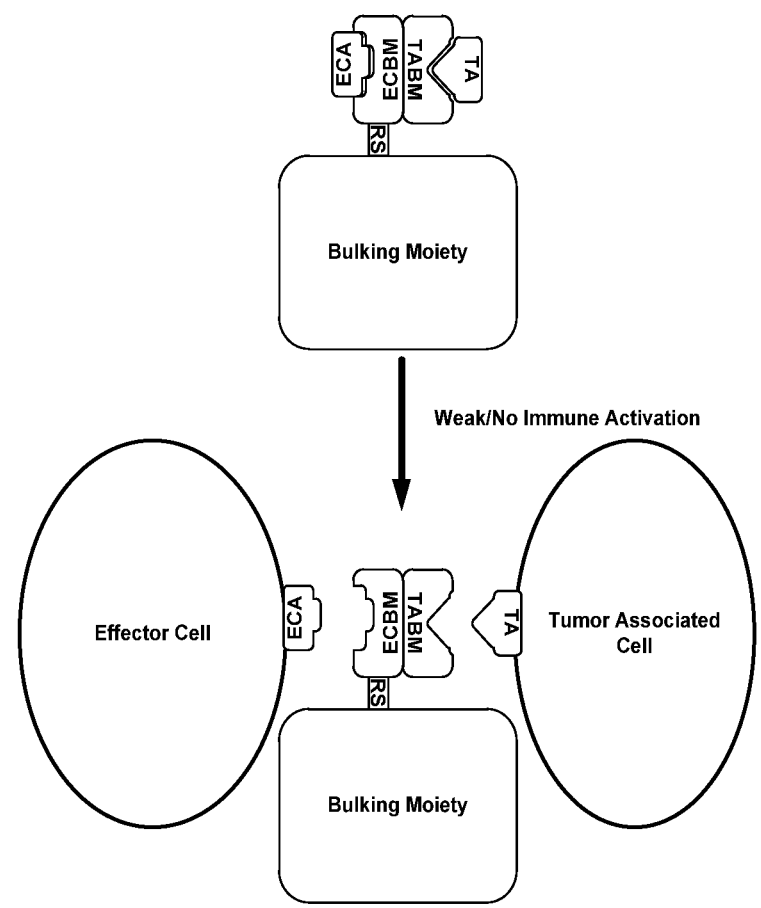
FIG. 3B
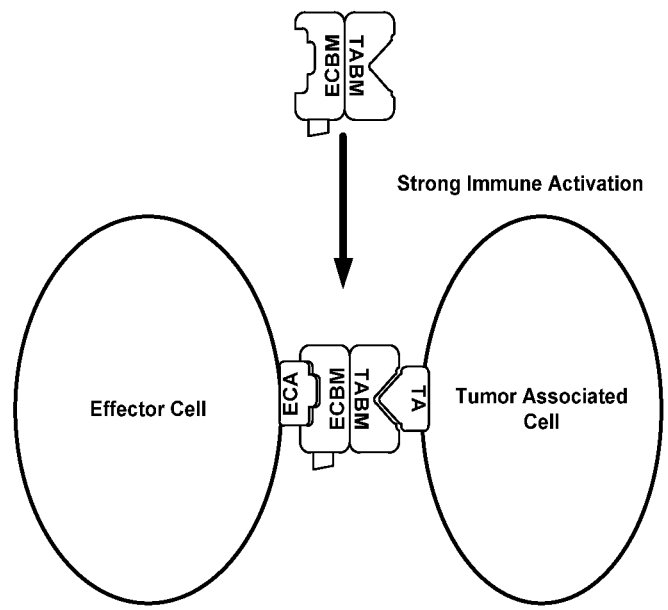
FIG. 3

FIG. 5A
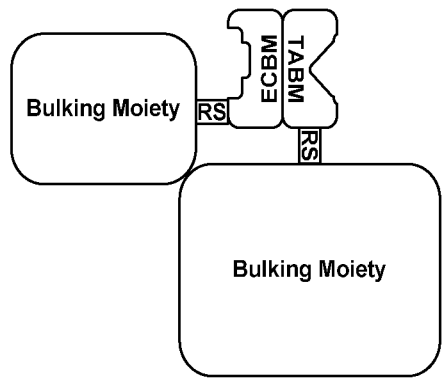
FIG. 5B
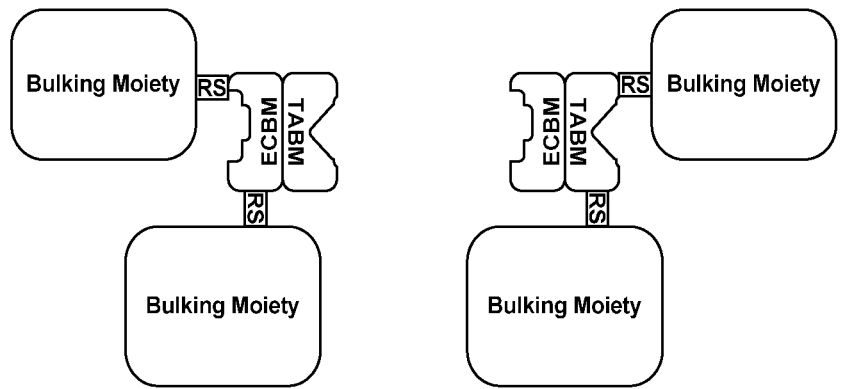
FIG. 5

FIG. 6A
FIG. 6B
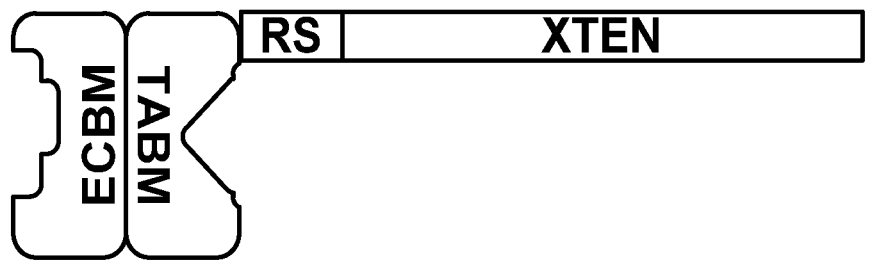
FIG. 6C
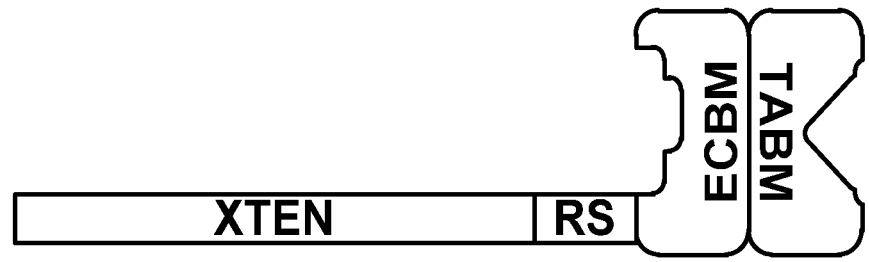
FIG. 6D
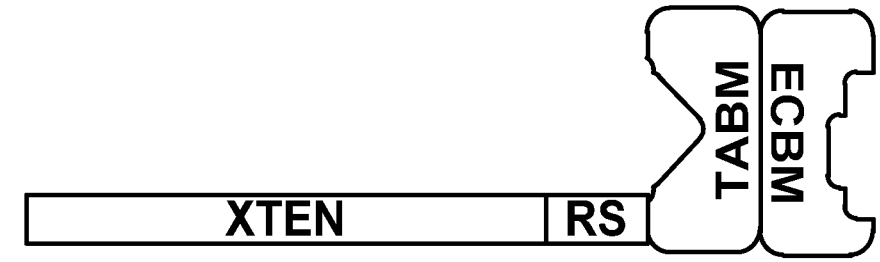
FIG. 6

FIG. 7A
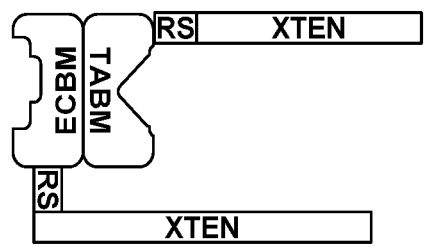
FIG. 7B
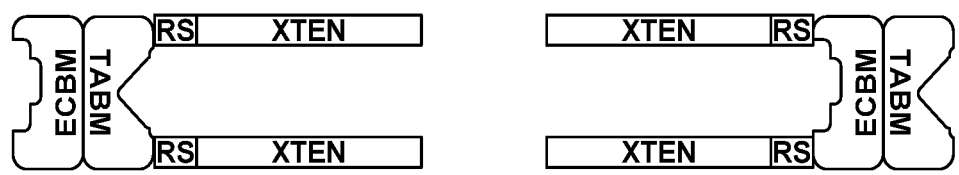
FIG. 7

FIG. 8A
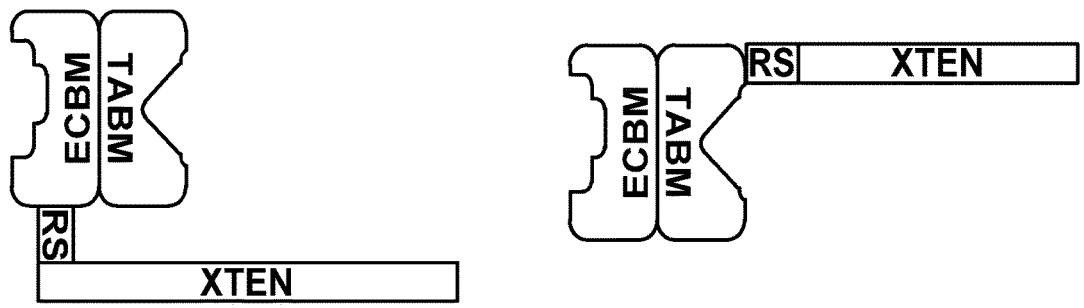
FIG. 8B
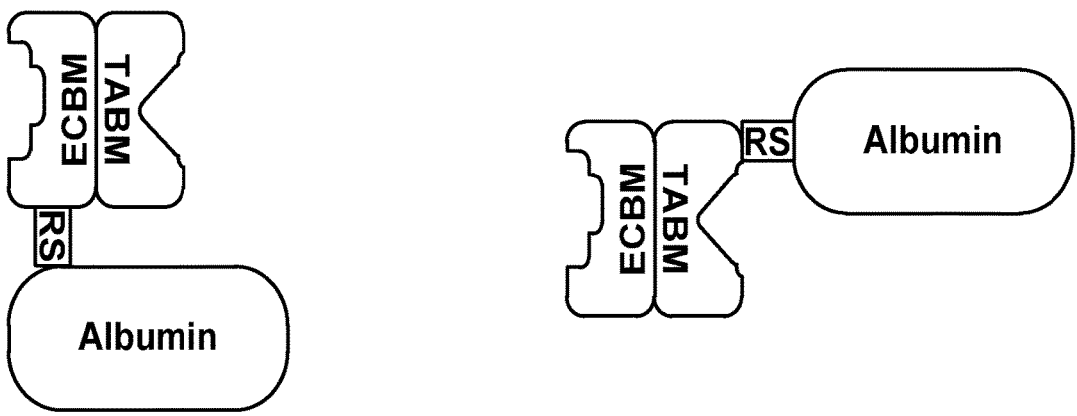
FIG. 8C
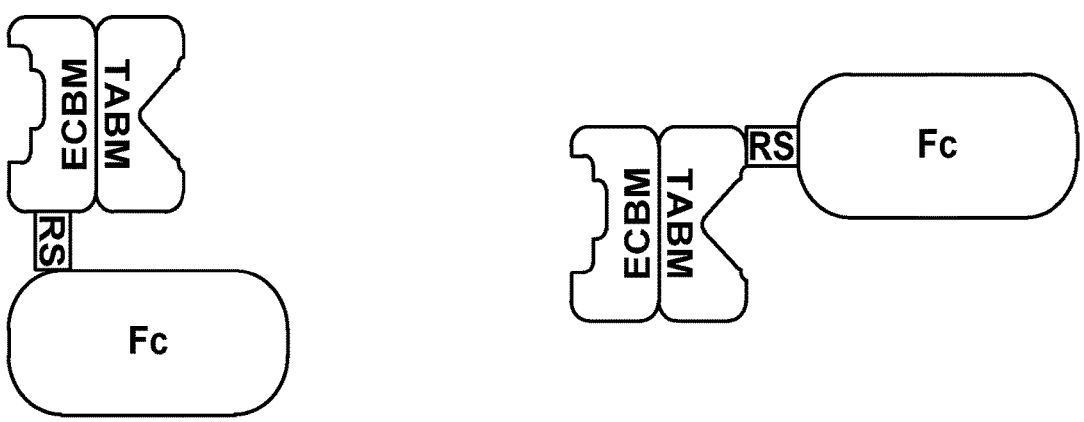
FIG. 8

FIG. 9A
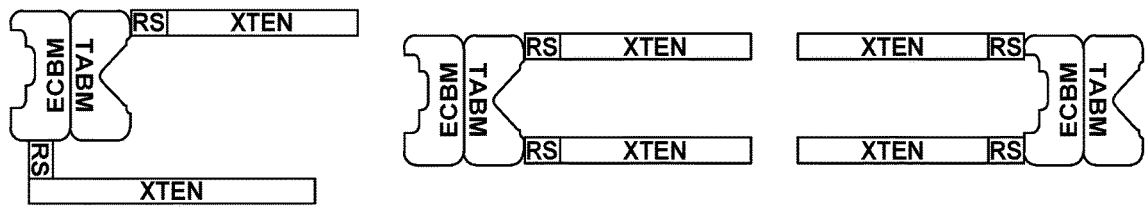
FIG. 9B
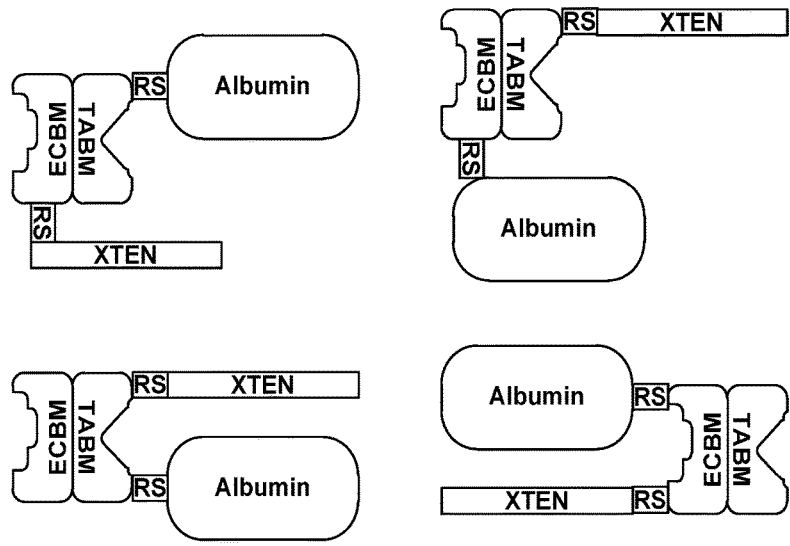
FIG. 9C
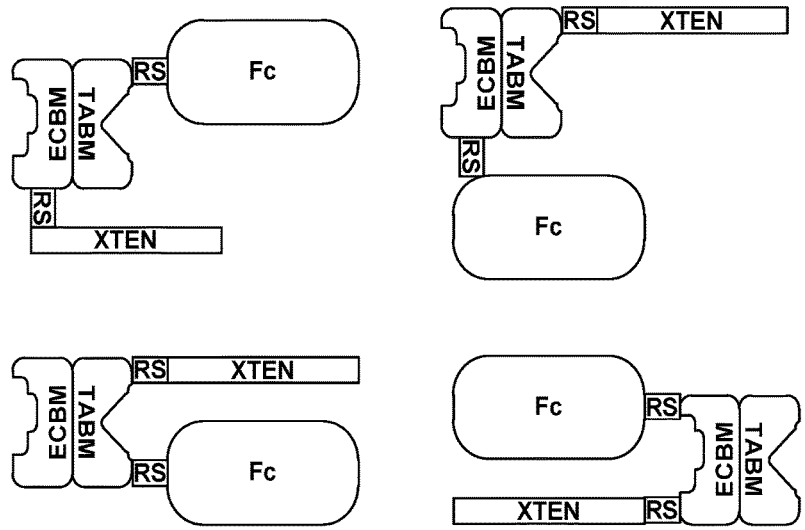
FIG. 9

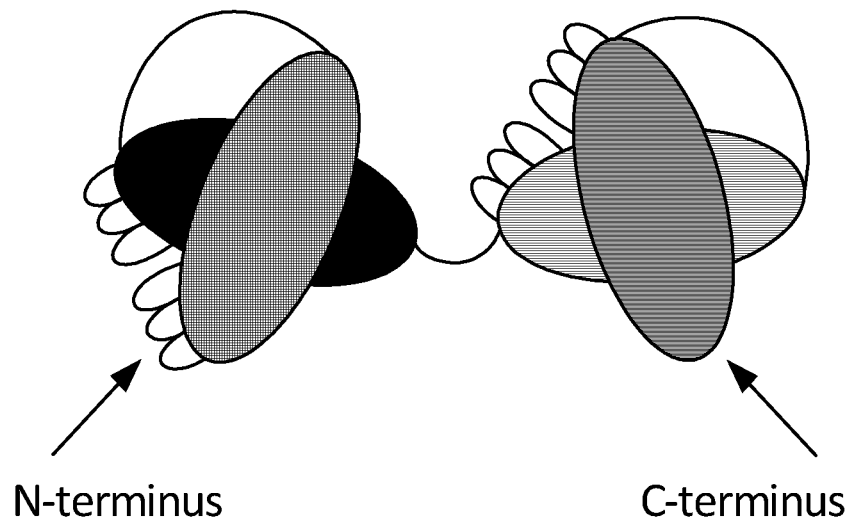
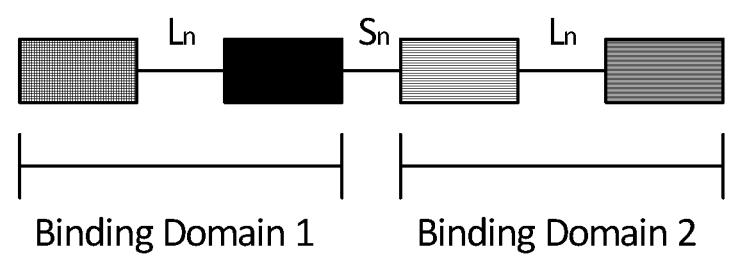
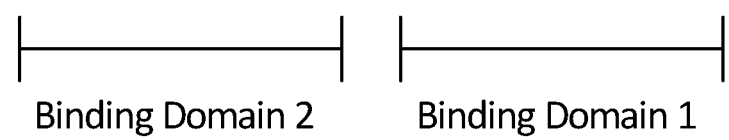
FIG. 11

Diabody Configuration
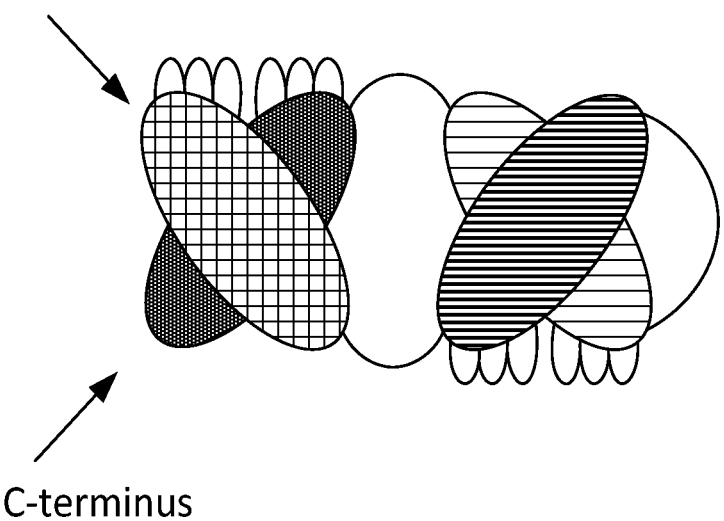
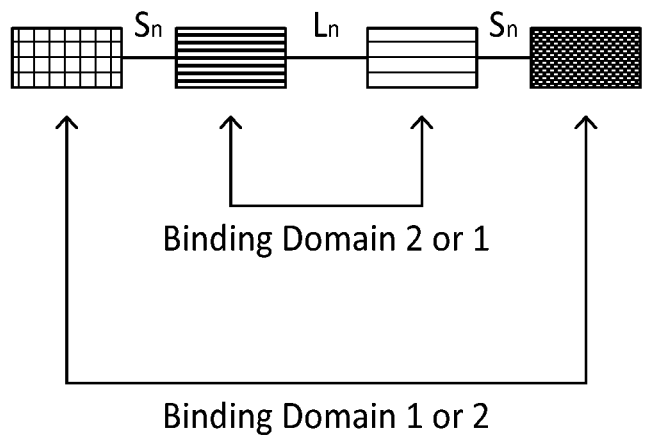
FIG. 12

FIG. 13A
Generic Construct Design
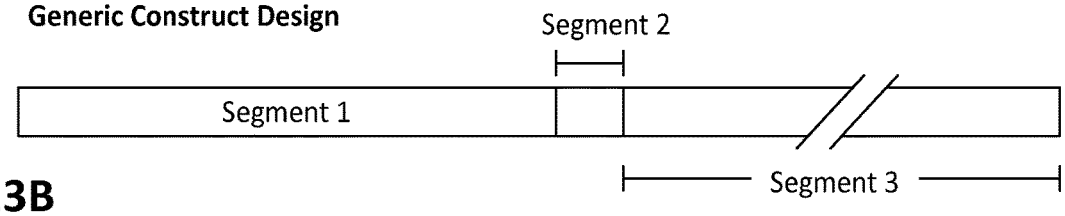
FIG. 13B
Tandem scFv Constructs
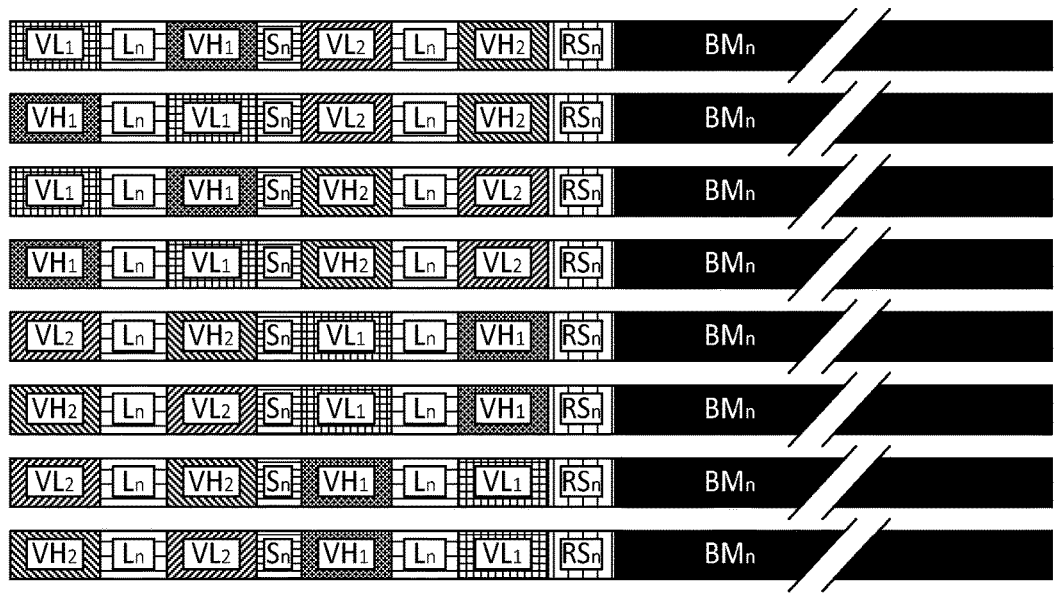
FIG. 13C
Diabody Constructs
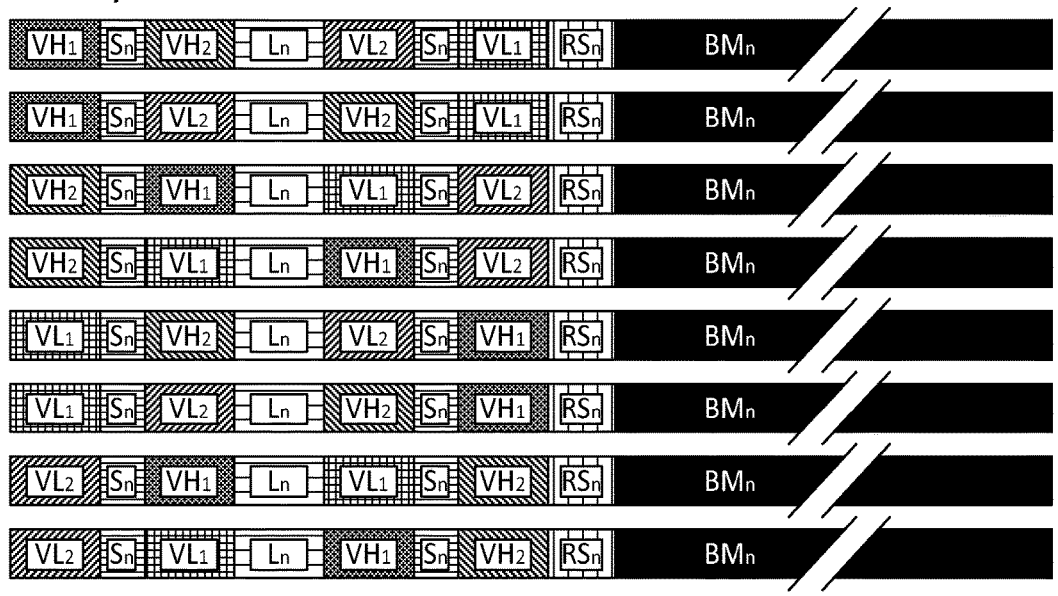
FIG. 13

FIG. 14A
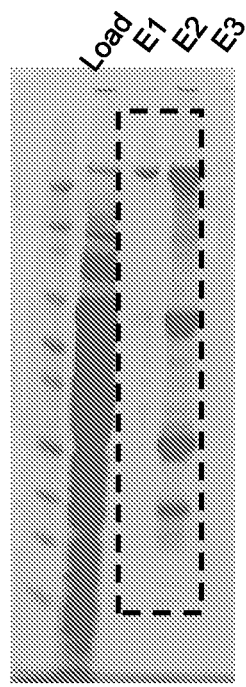
FIG. 14B
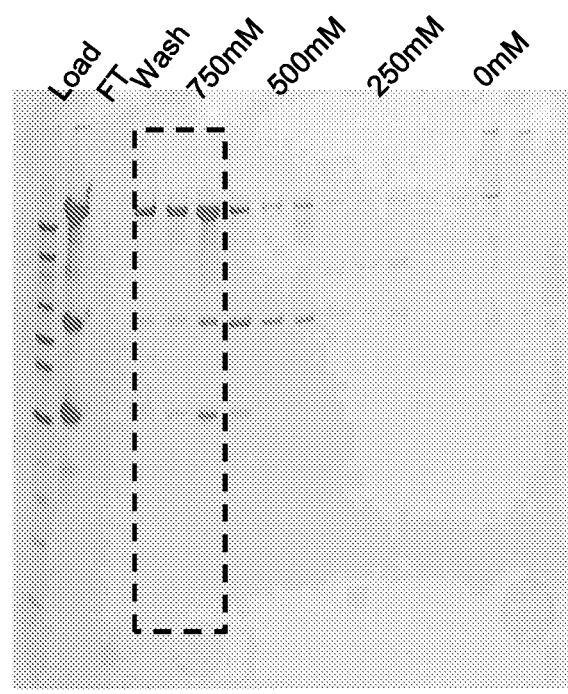
FIG. 14C
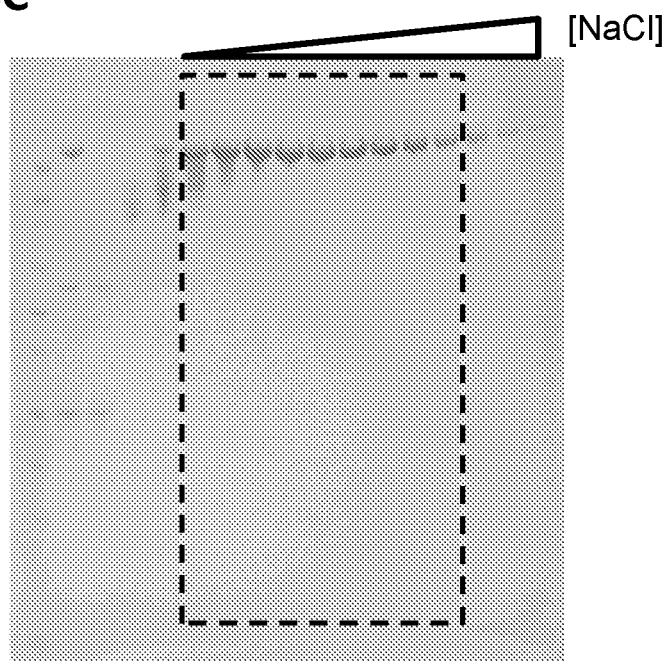
FIG. 14

FIG. 15A
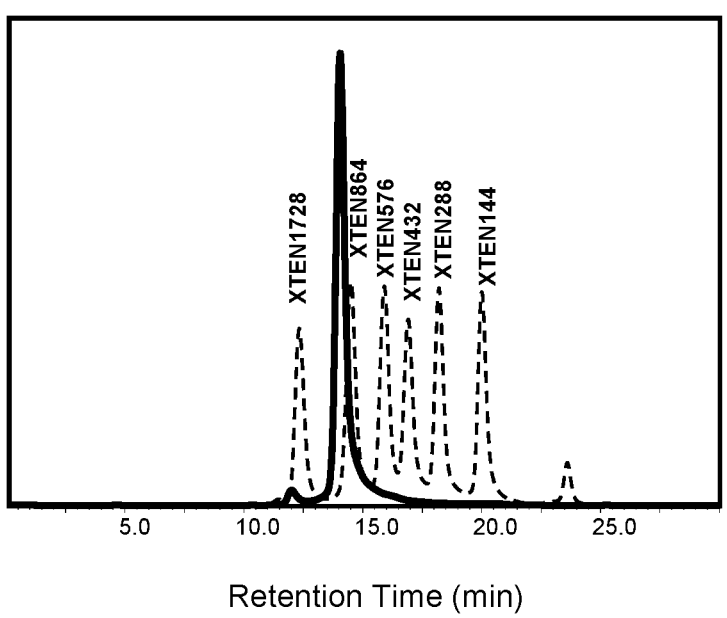
FIG. 15B
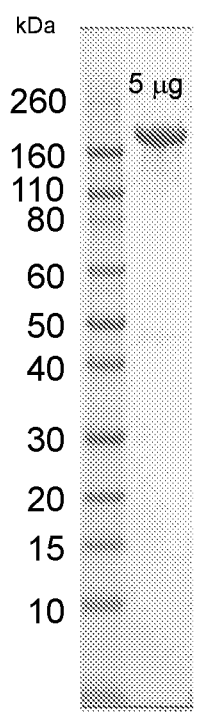
FIG. 15

FIG. 16A
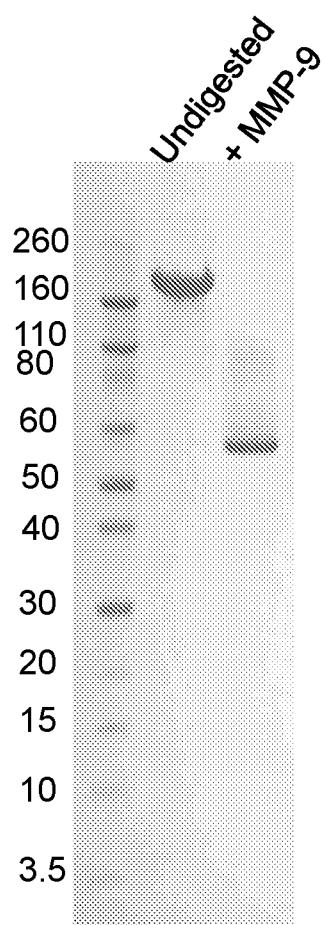
FIG. 16B
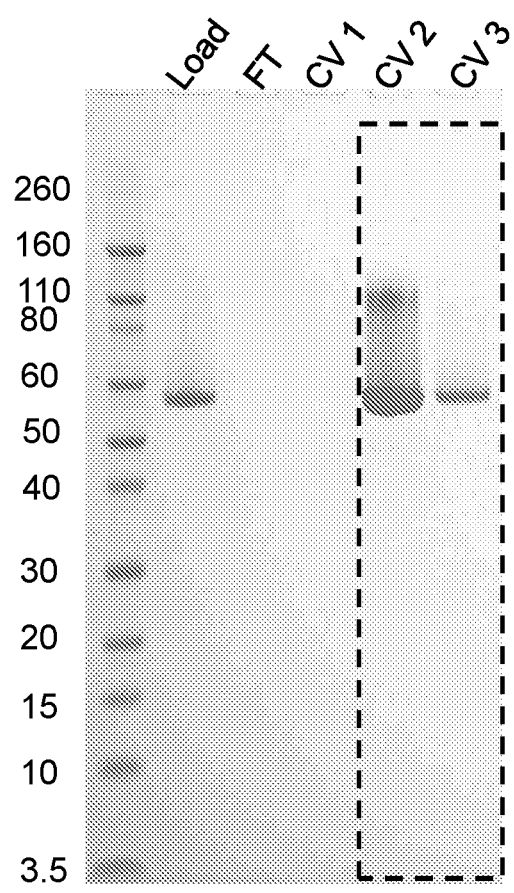
FIG. 16

FIG. 17A
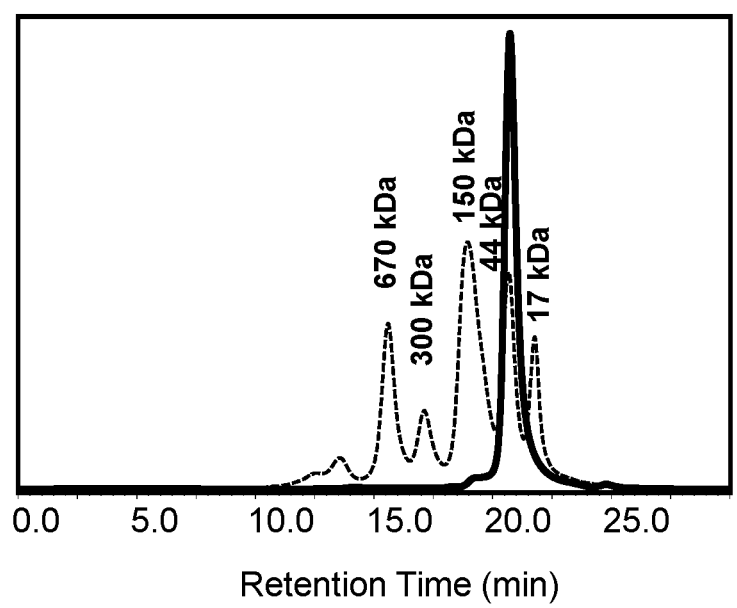
FIG. 17B
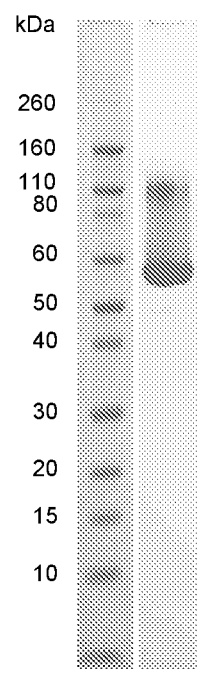
FIG. 17

FIG. 18A
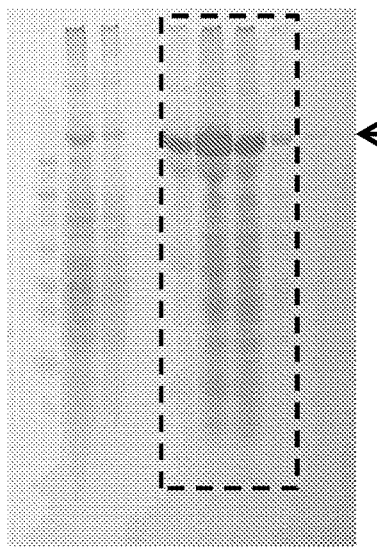
FIG. 18B
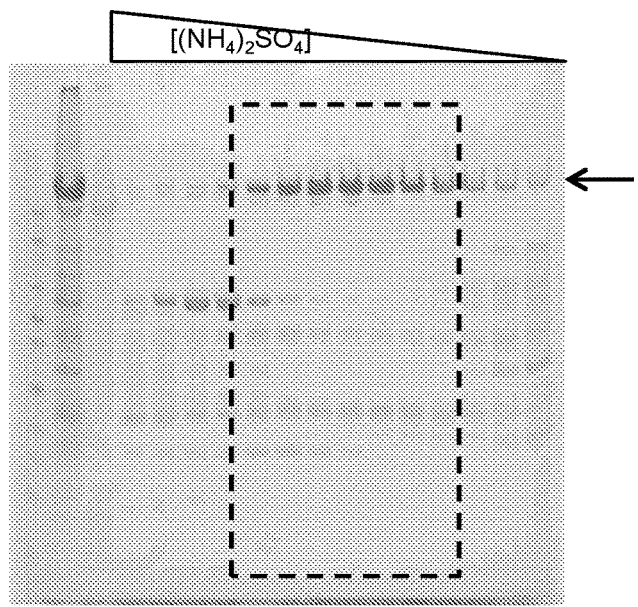
FIG. 18C
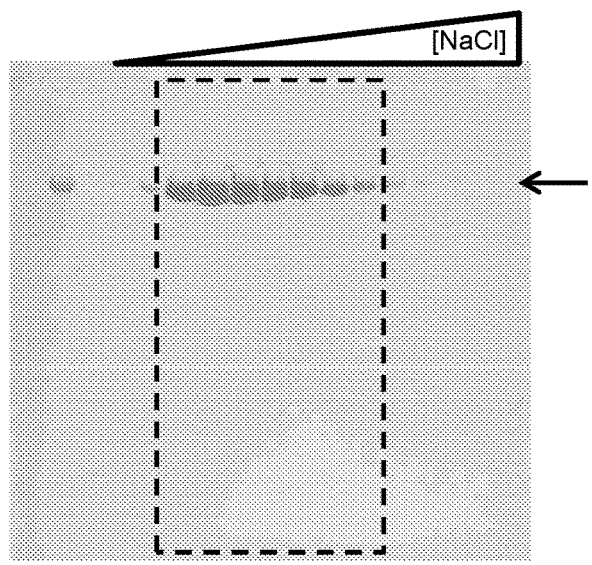
FIG. 18

FIG. 19A
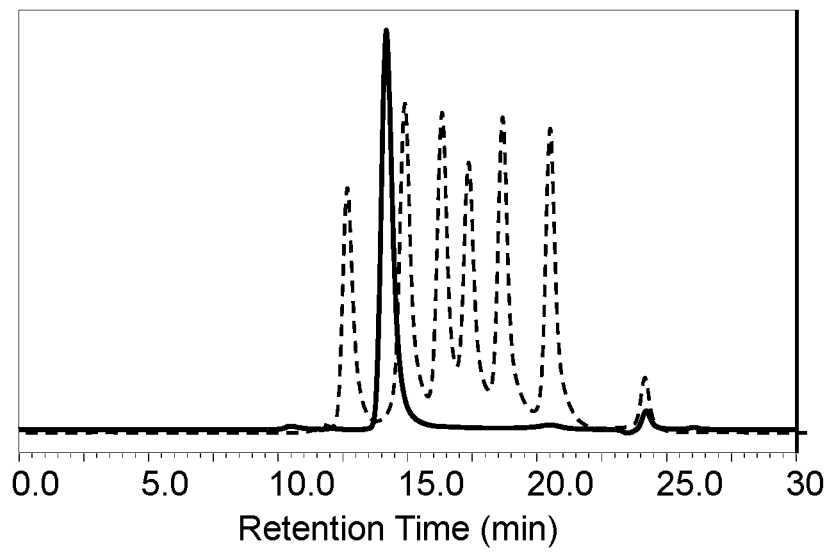
FIG. 19B
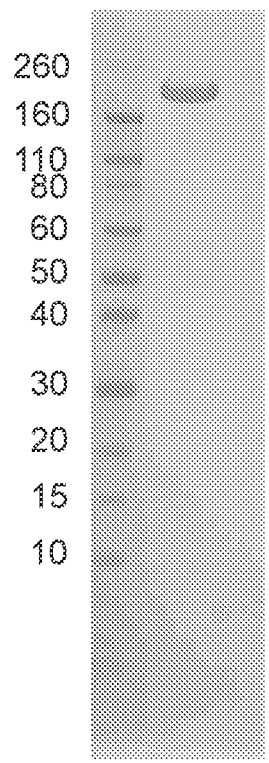
FIG. 19C
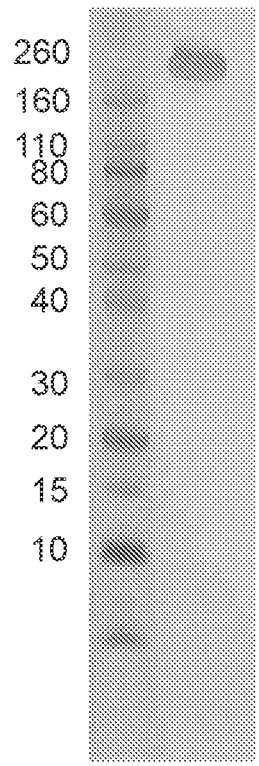
FIG. 19

FIG. 20A
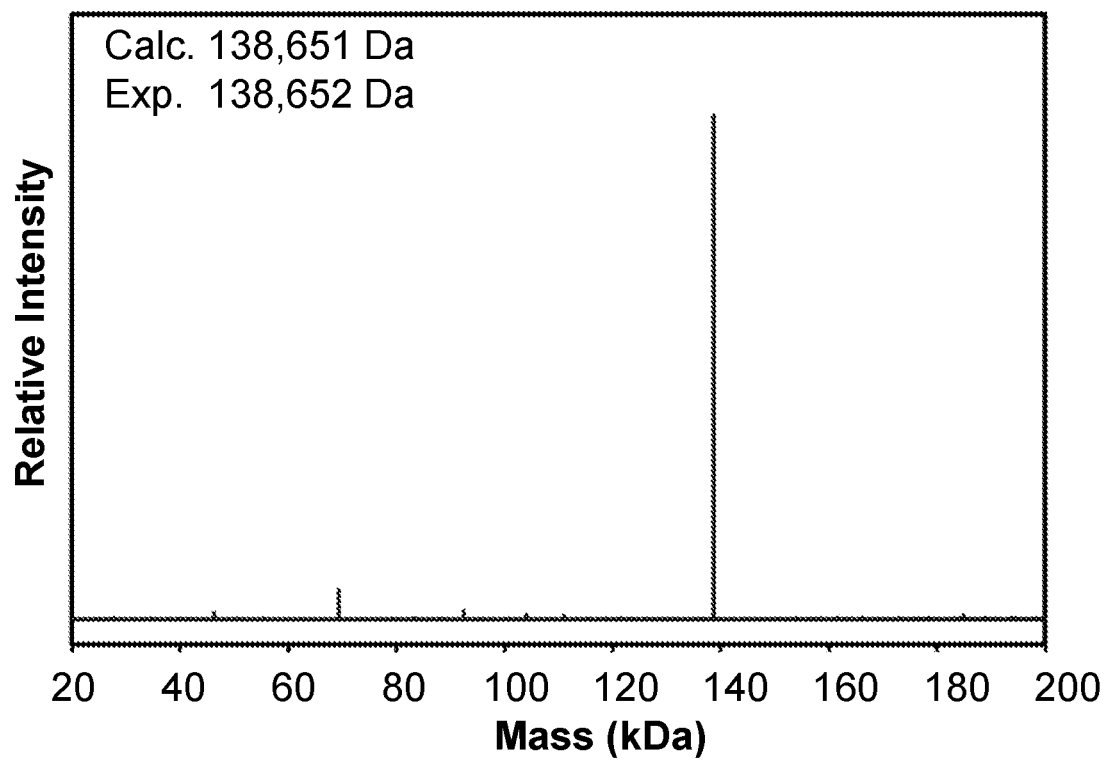
FIG. 20B
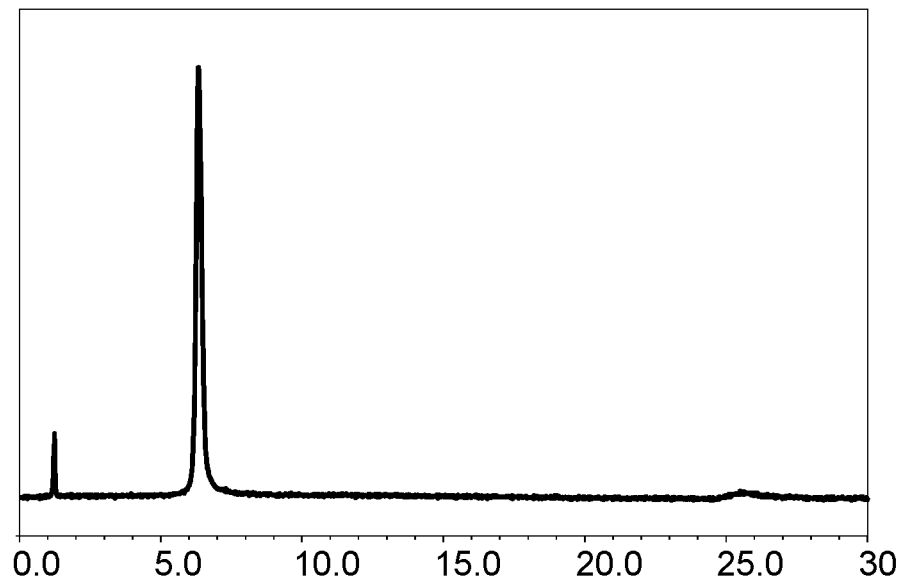
FIG. 20

FIG. 21A
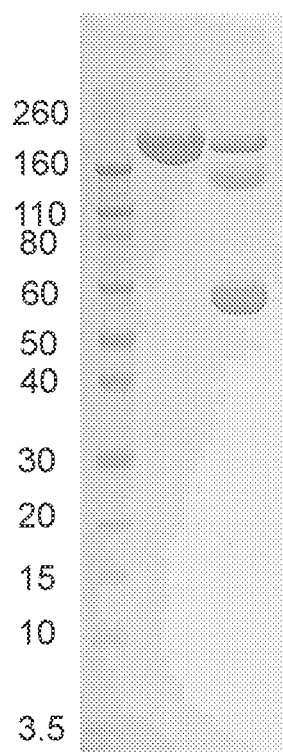
FIG. 21B
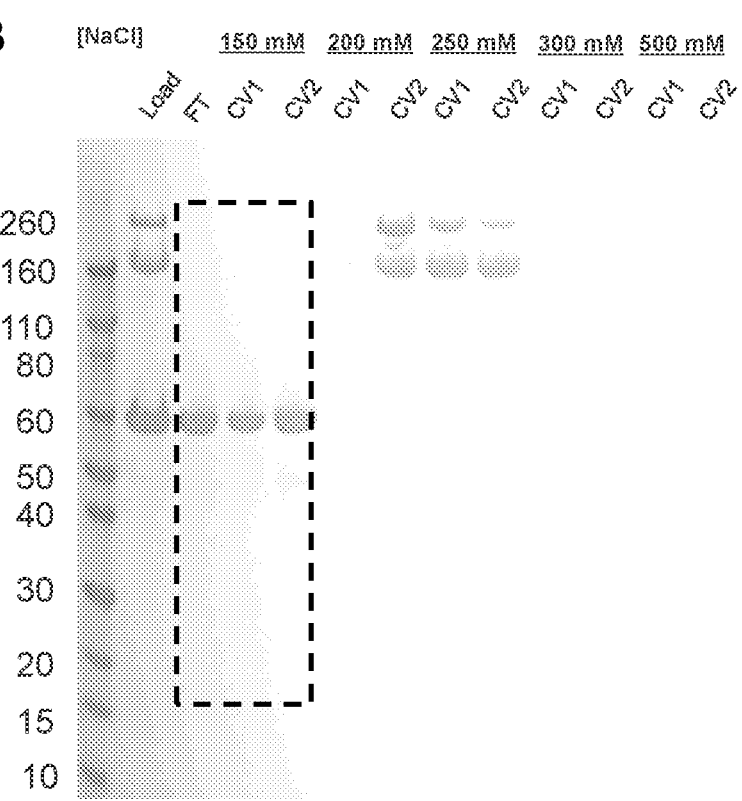
FIG. 21

FIG. 22A
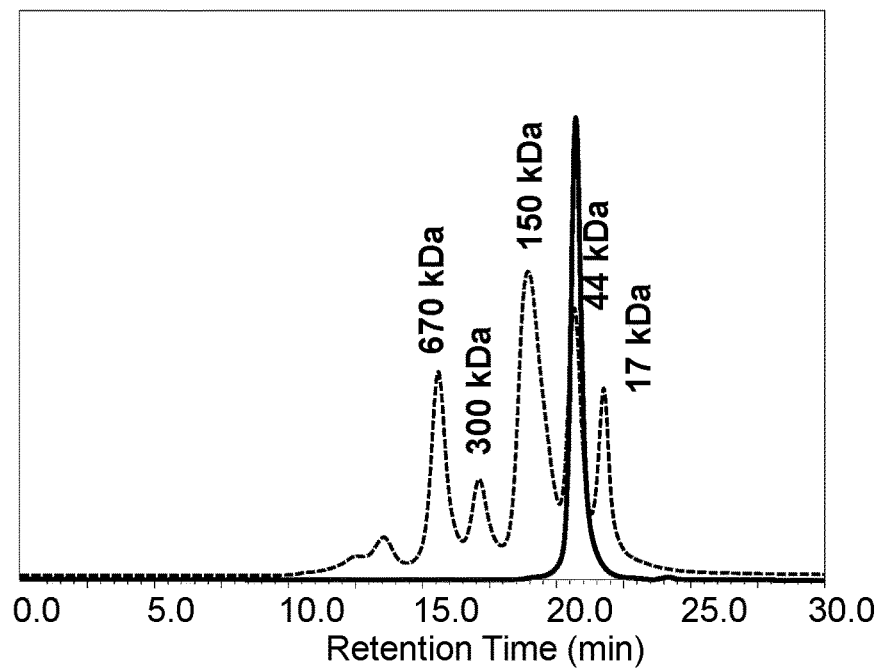
FIG. 22B
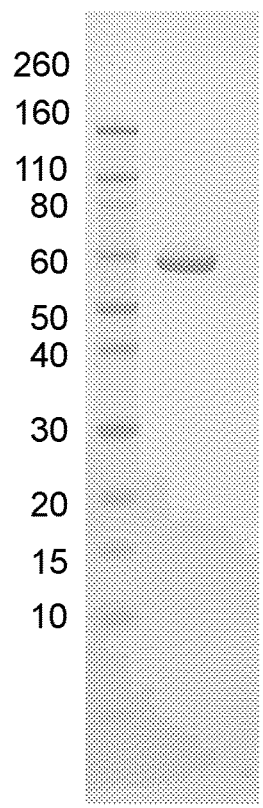
FIG. 22C
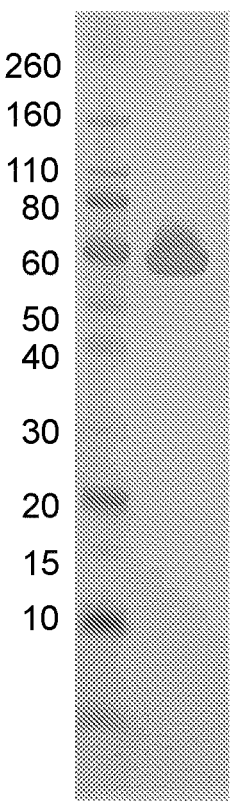
FIG. 22

FIG. 23A
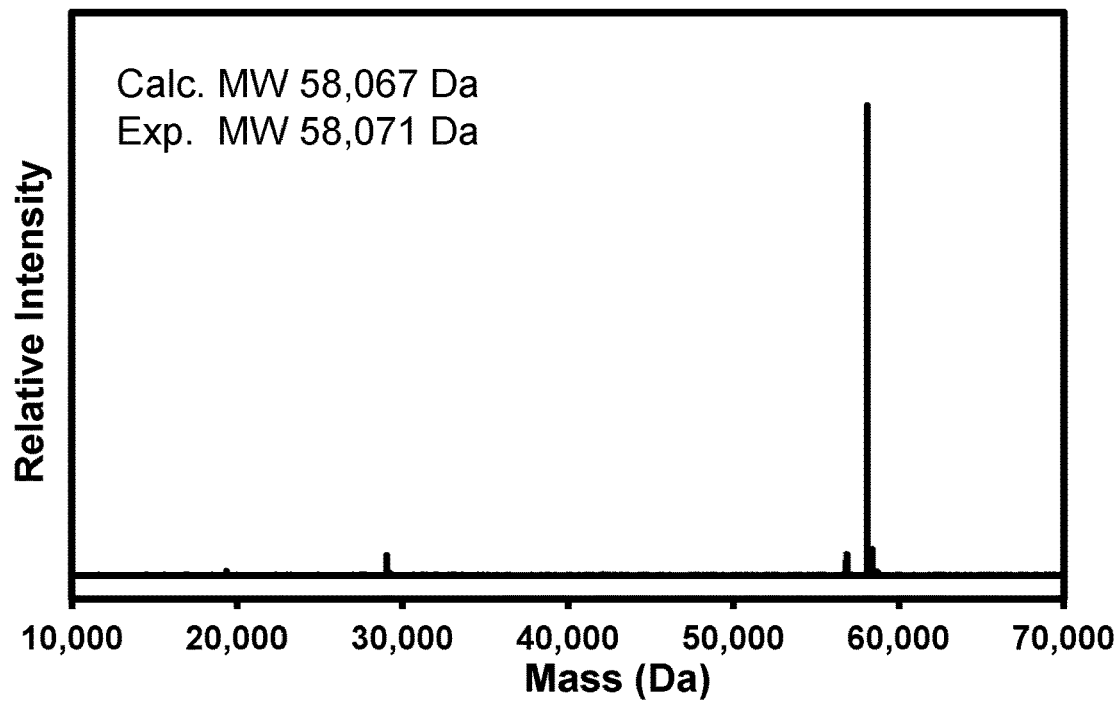
FIG. 23B
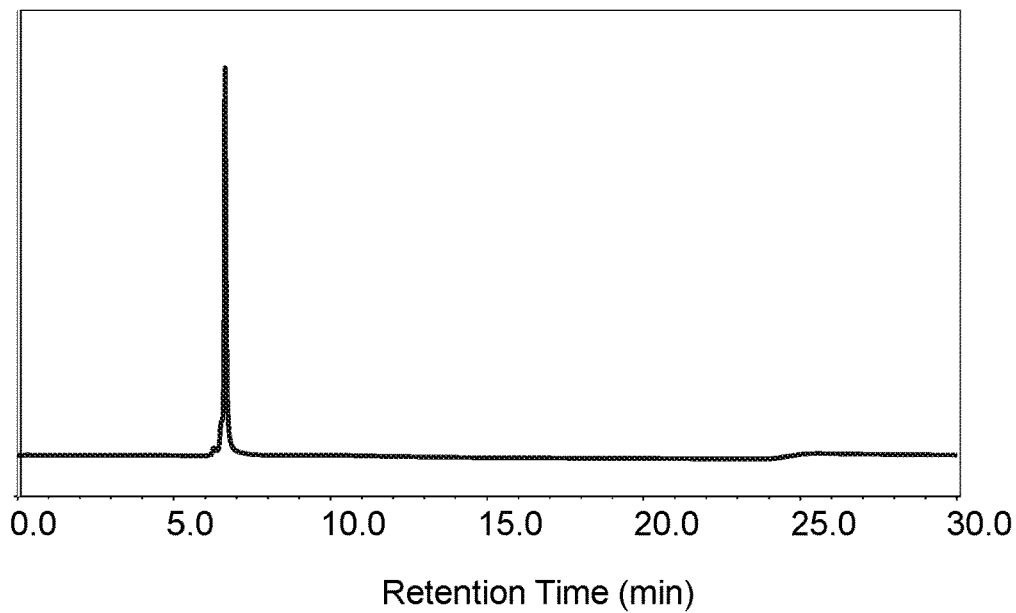
FIG. 23

FIG. 29A
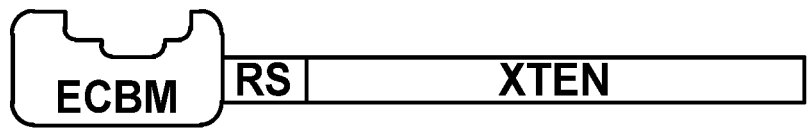
FIG. 29B
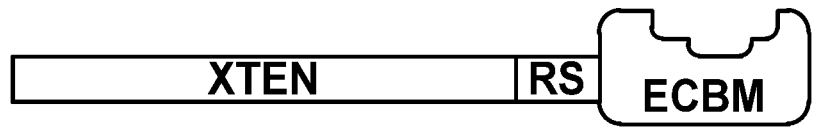
FIG. 29

FIG. 33A
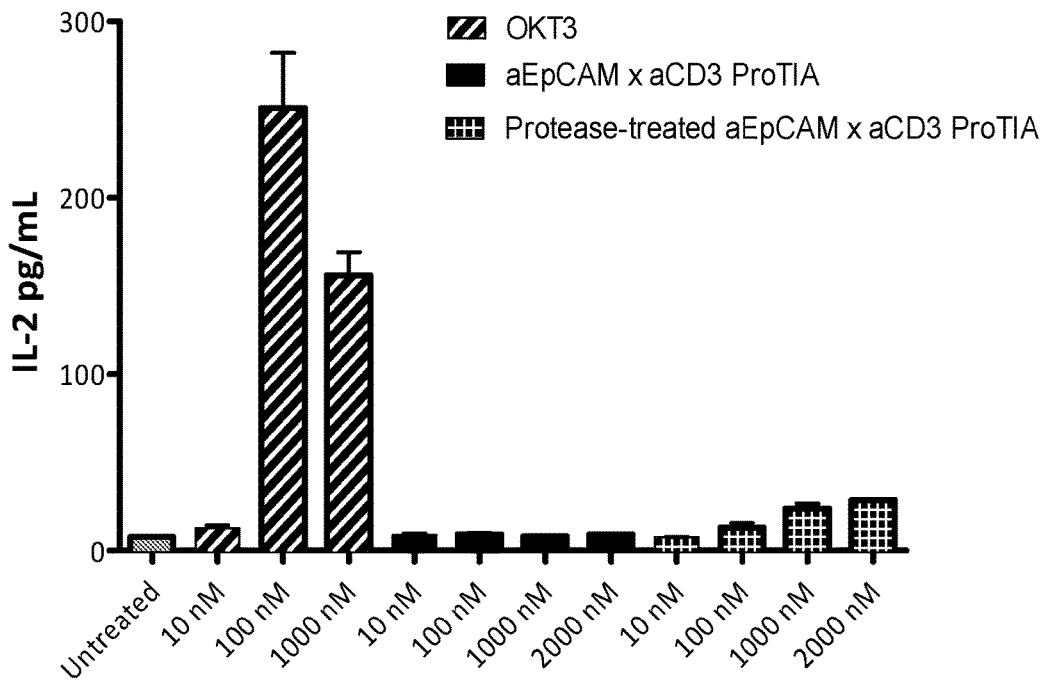
FIG. 33B
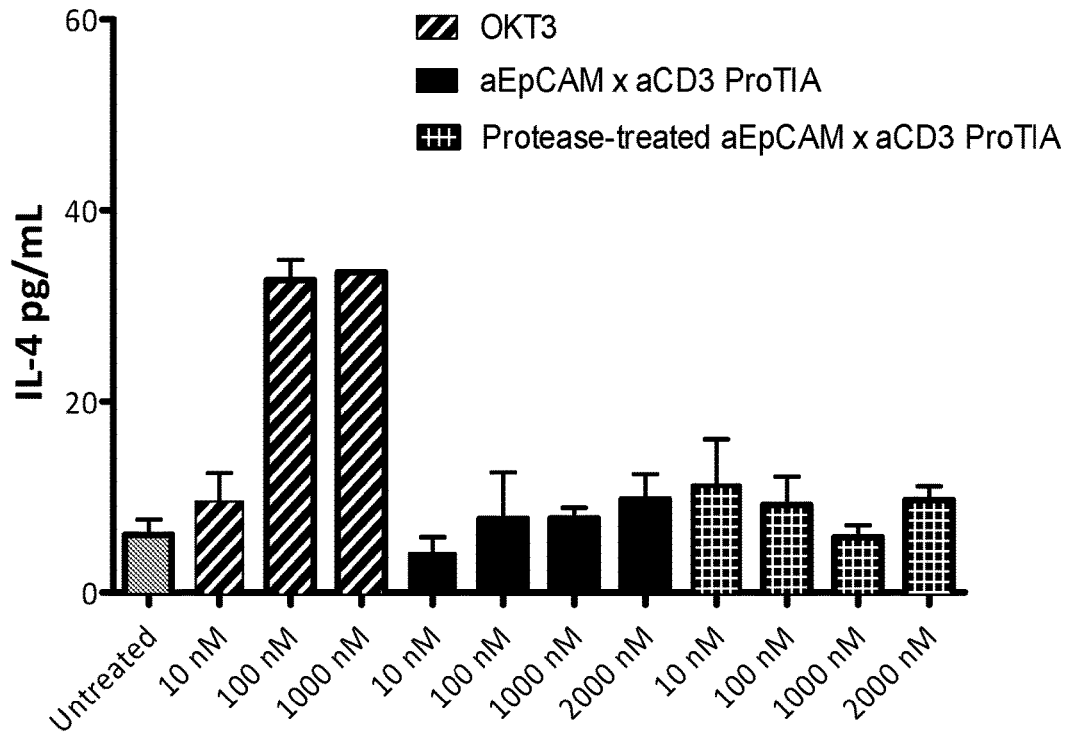
FIG. 33

FIG. 34A
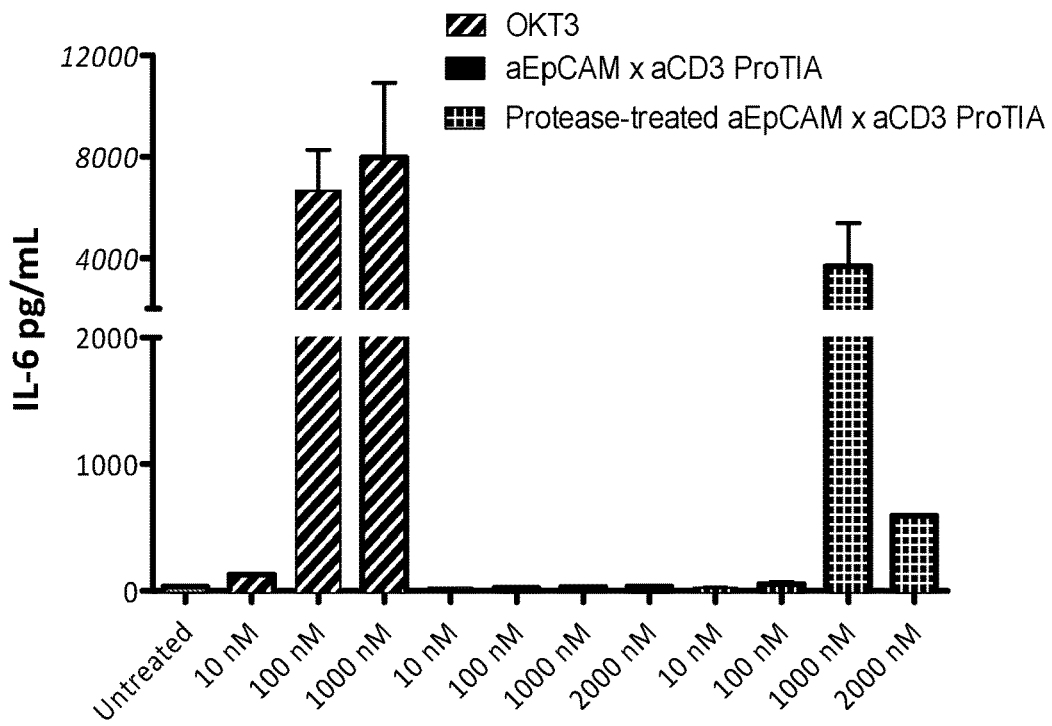
FIG. 34B
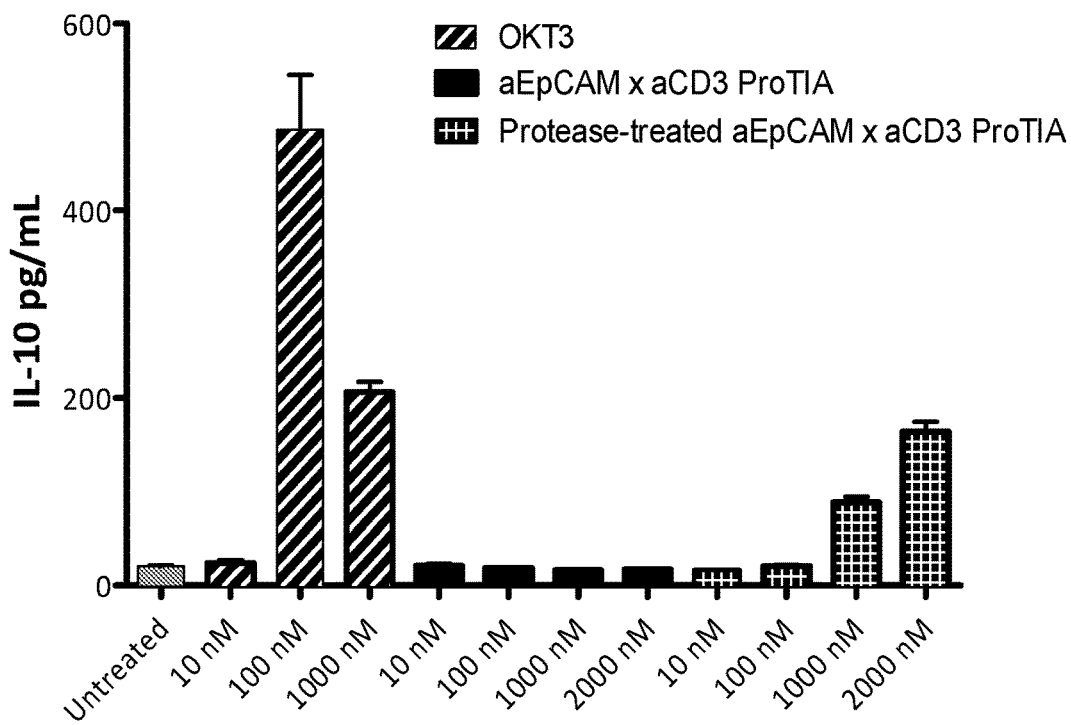
FIG. 34

FIG. 35A
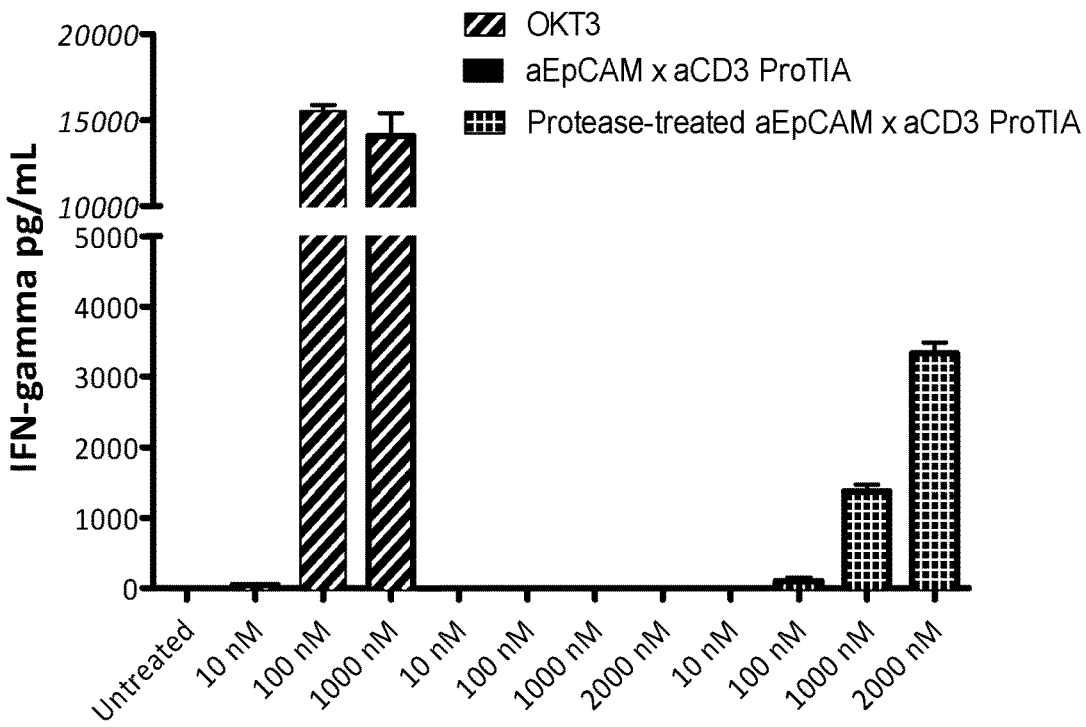
FIG. 35B
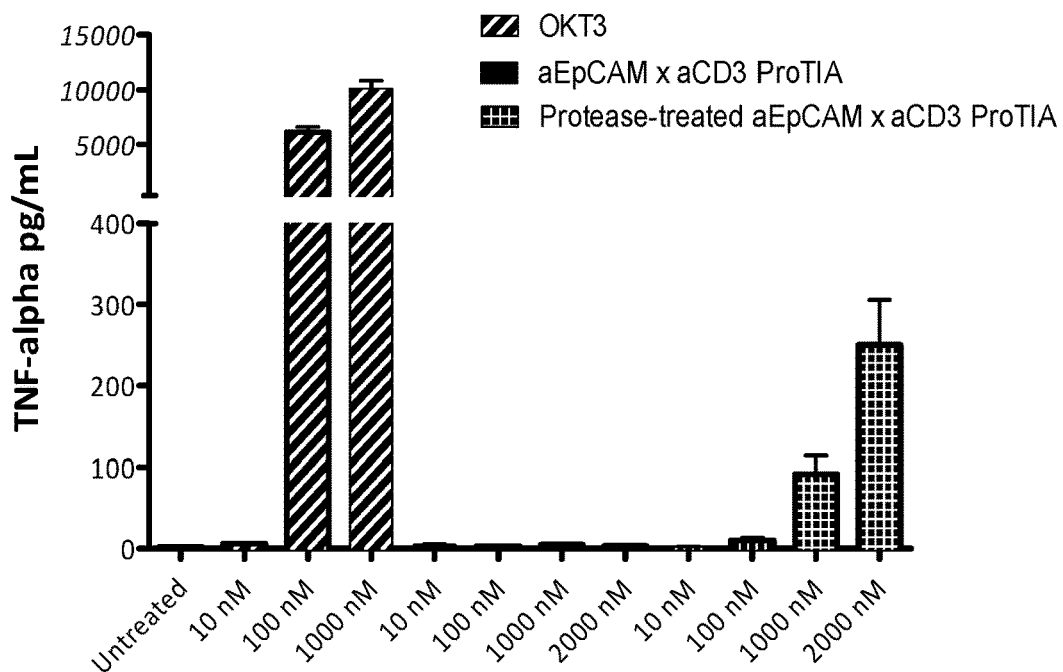
FIG. 35

FIG. 42A
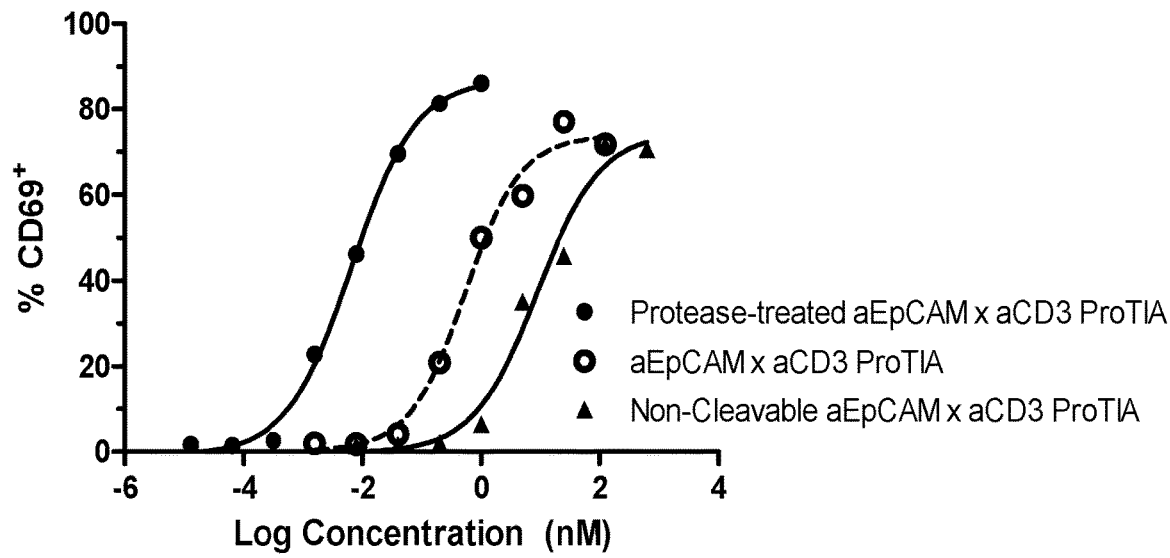
FIG. 42B
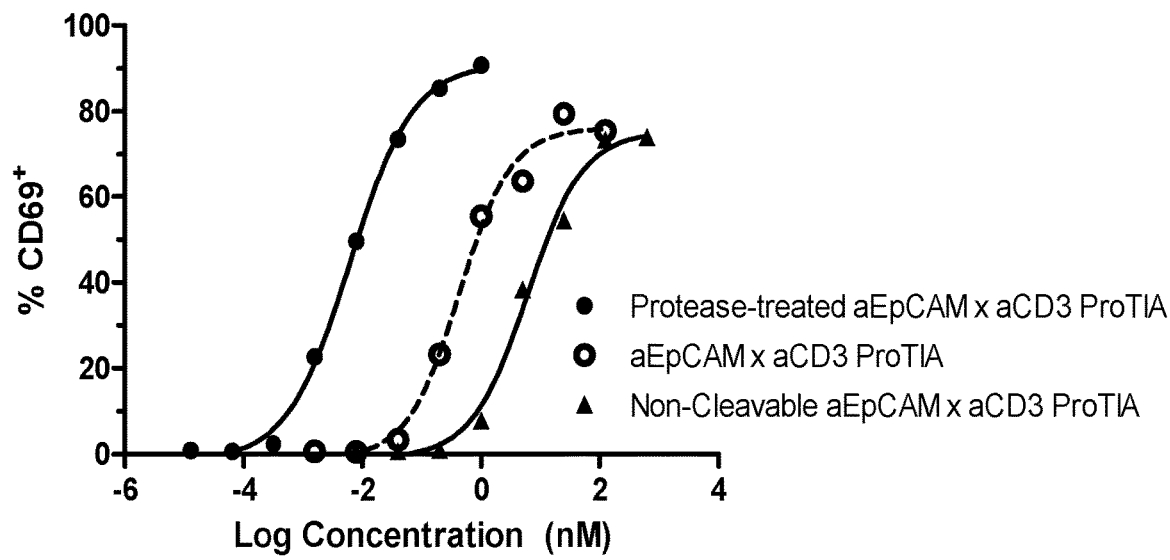
FIG. 42

FIG. 43A
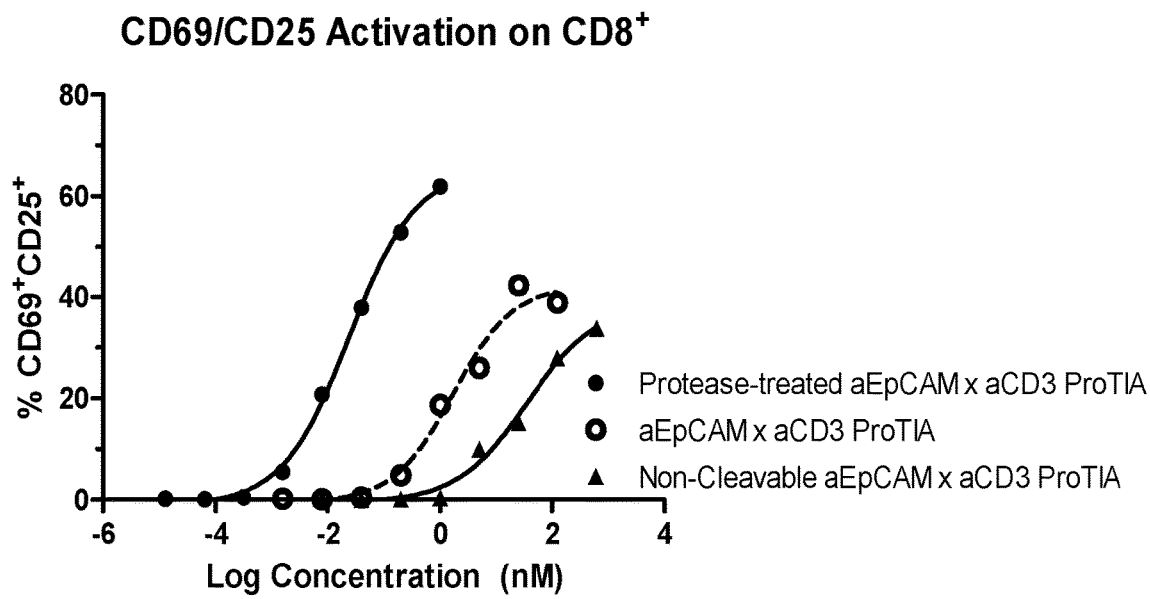
FIG. 43B
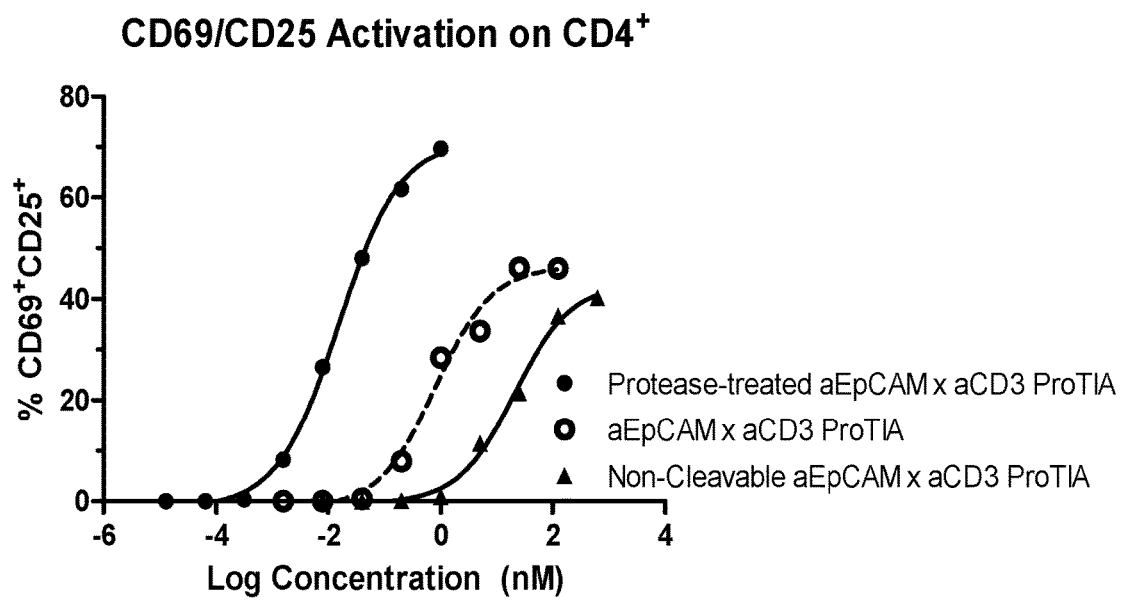
FIG. 43

FIG. 44A
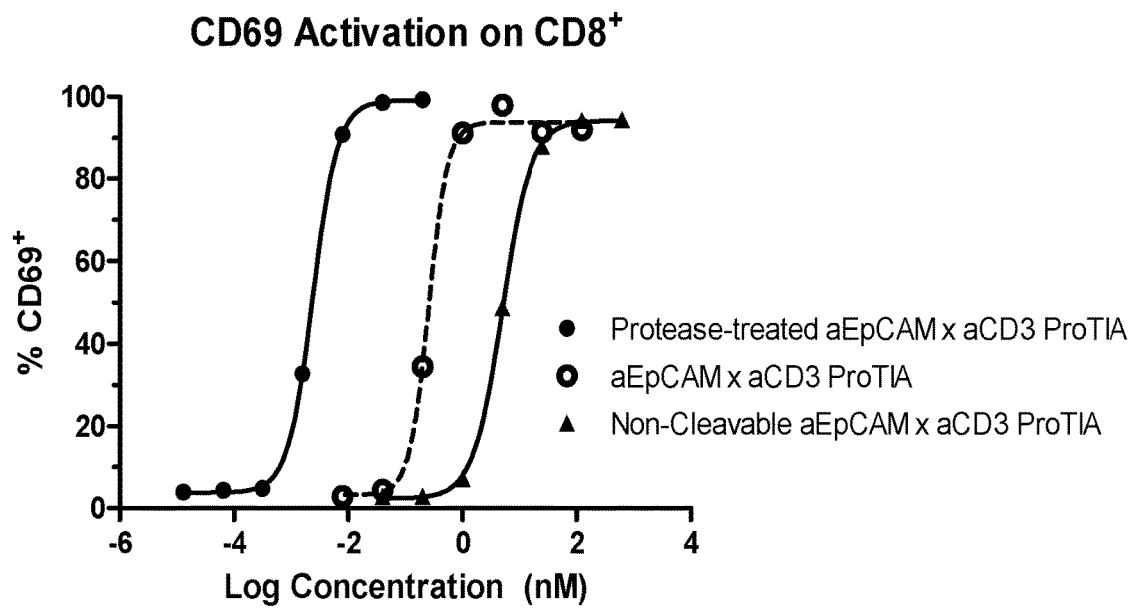
FIG. 44B
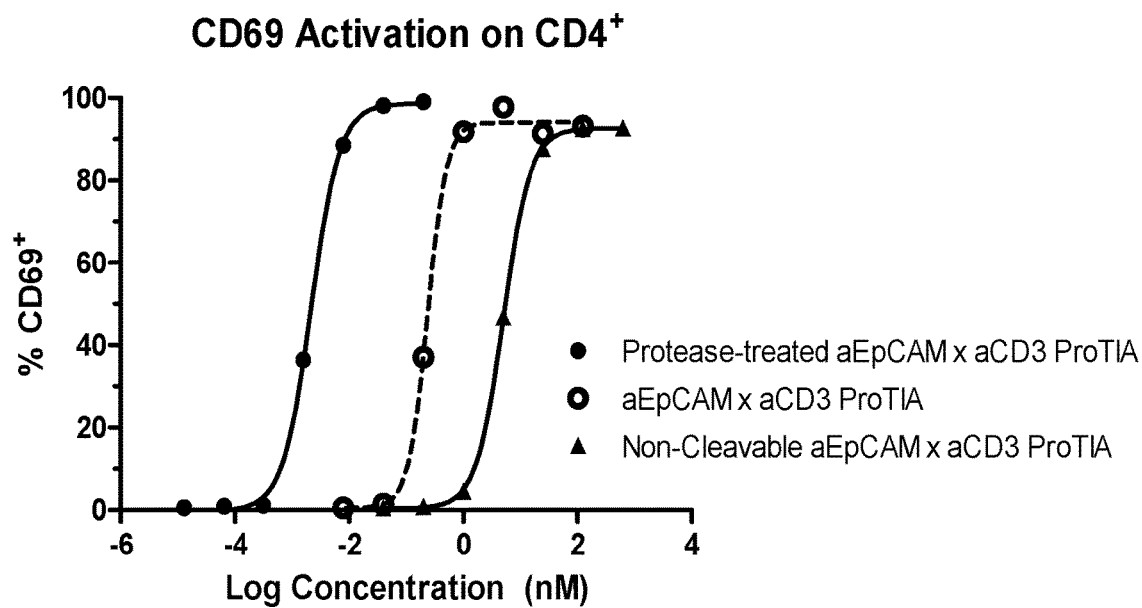
FIG. 44

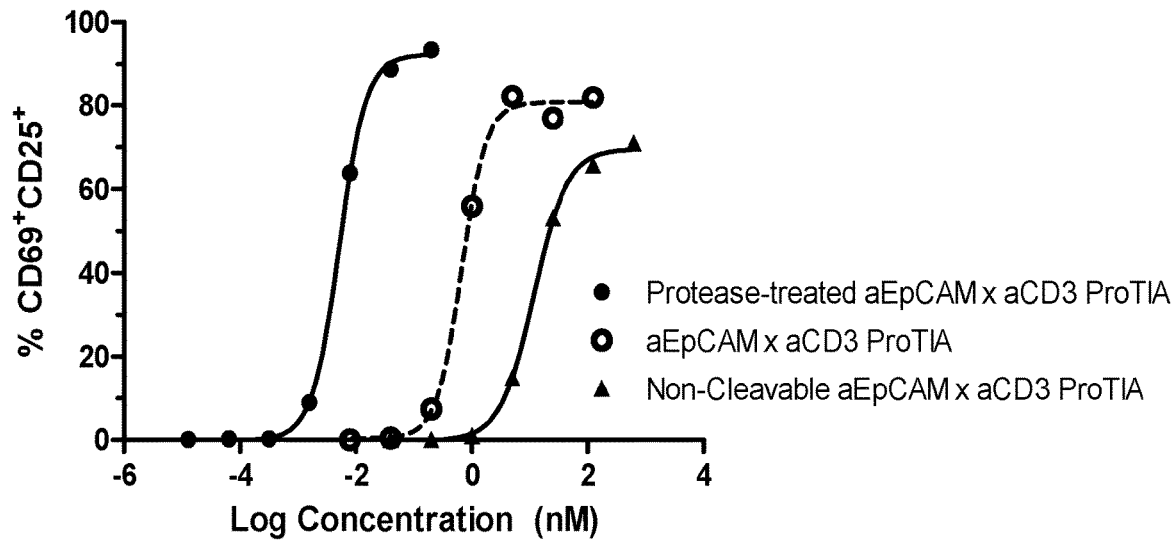
FIG. 45A
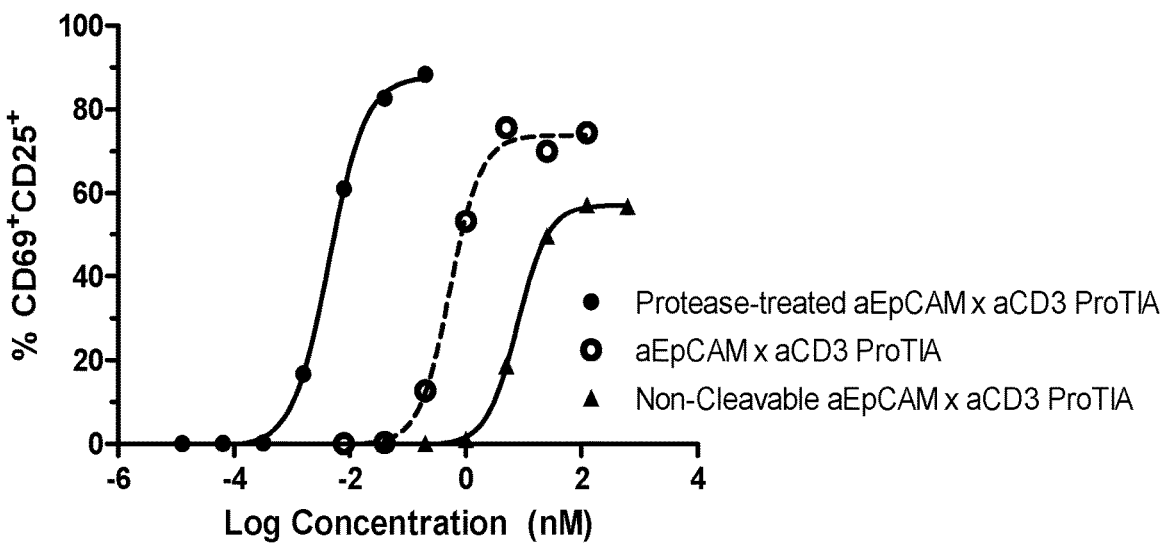
FIG. 45B
FIG. 45

FIG. 46A
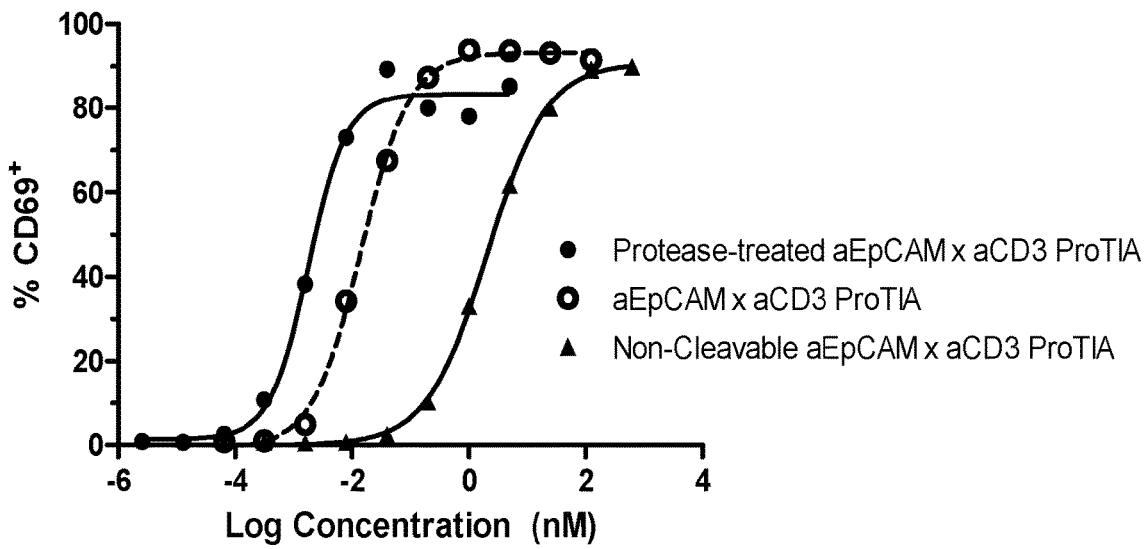
FIG. 46B
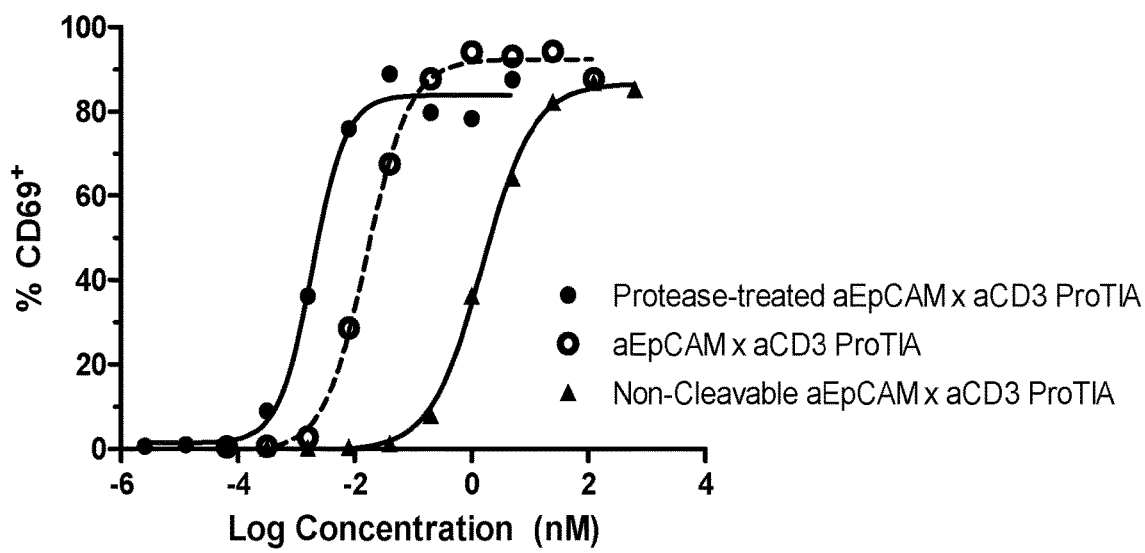
FIG. 46

FIG. 47A
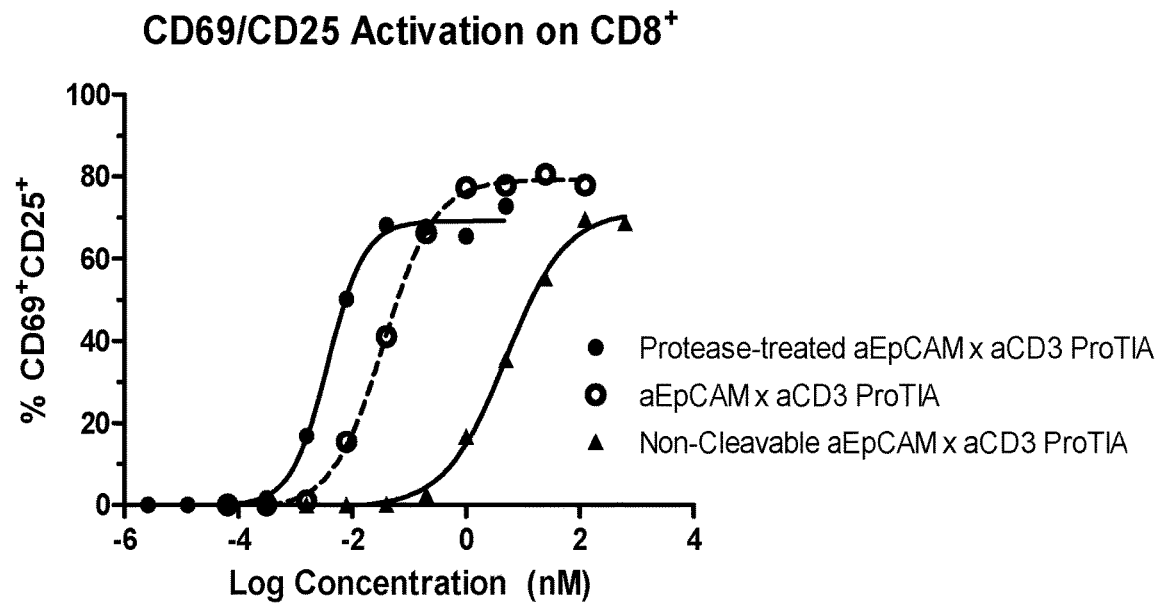
FIG. 47B
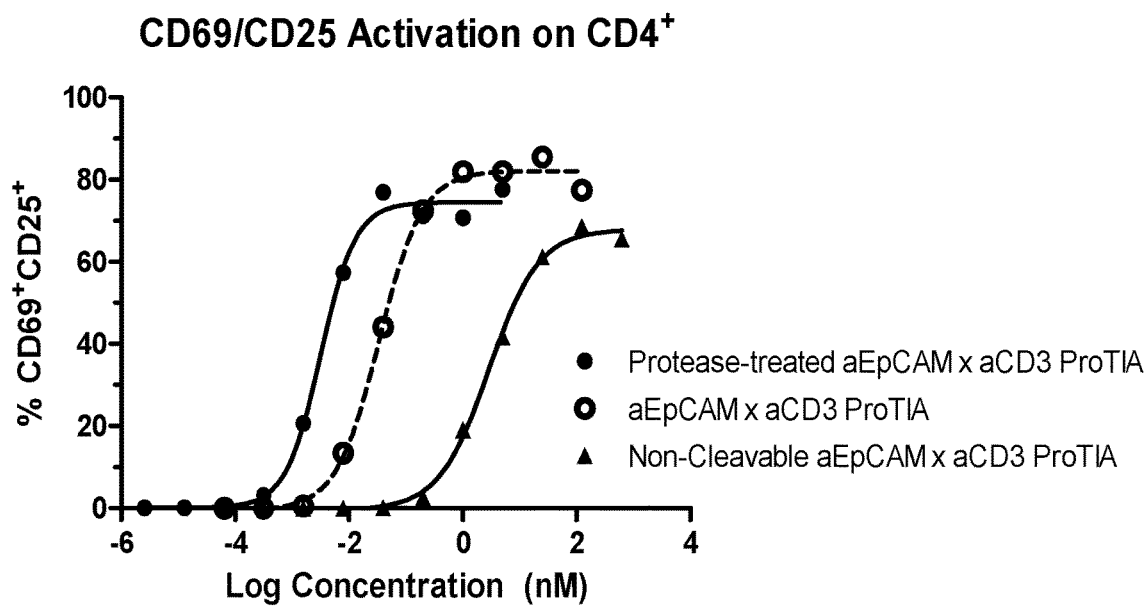
FIG. 47

FIG. 48A
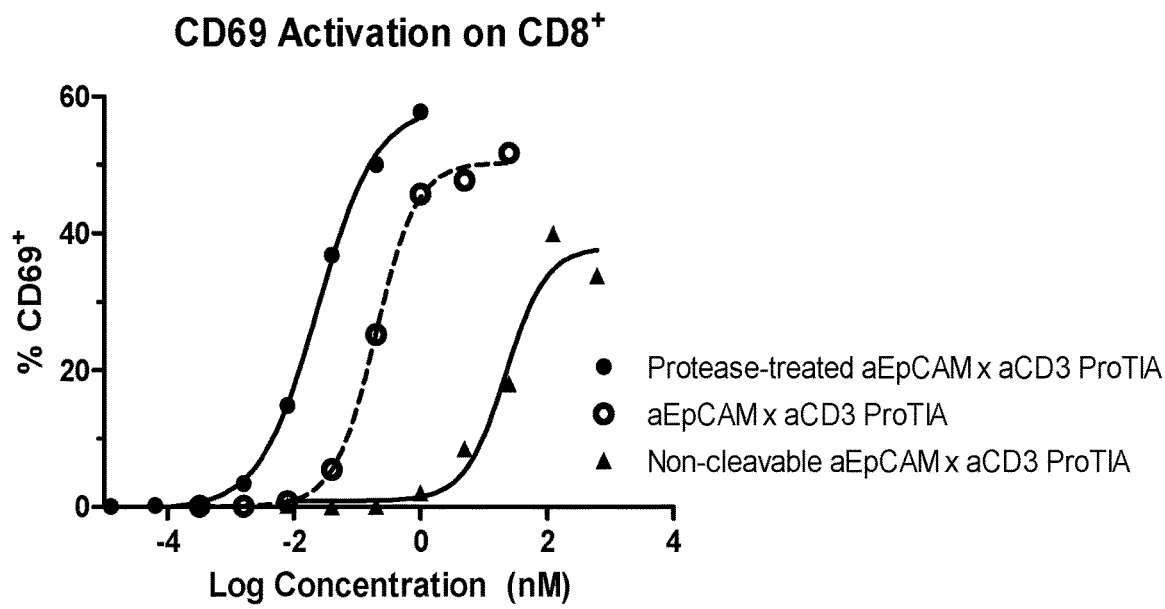
FIG. 48B
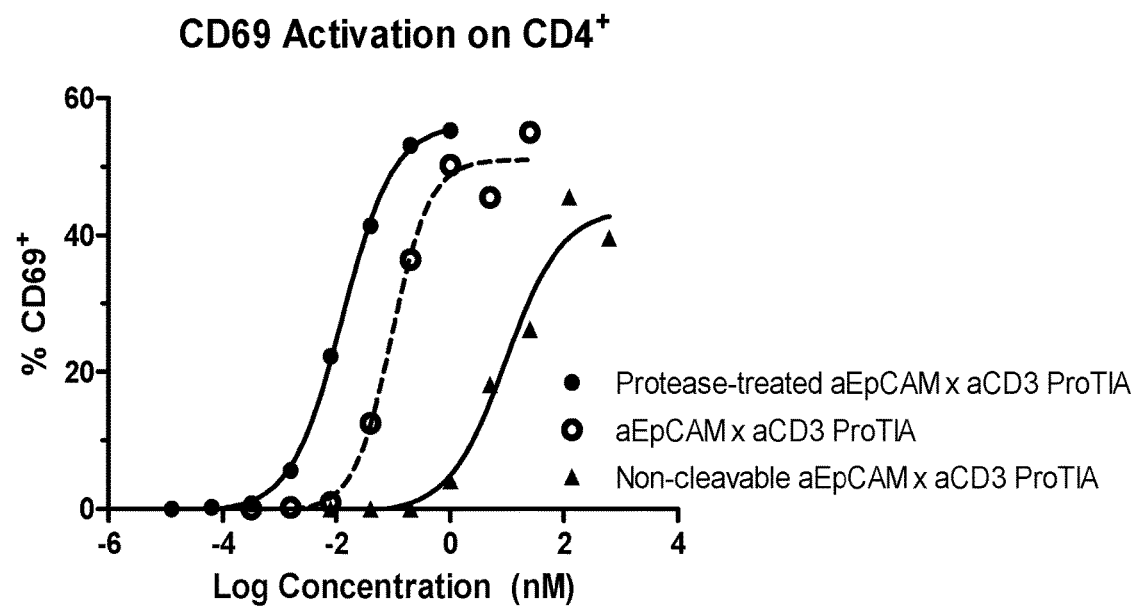
FIG. 48

FIG. 49A
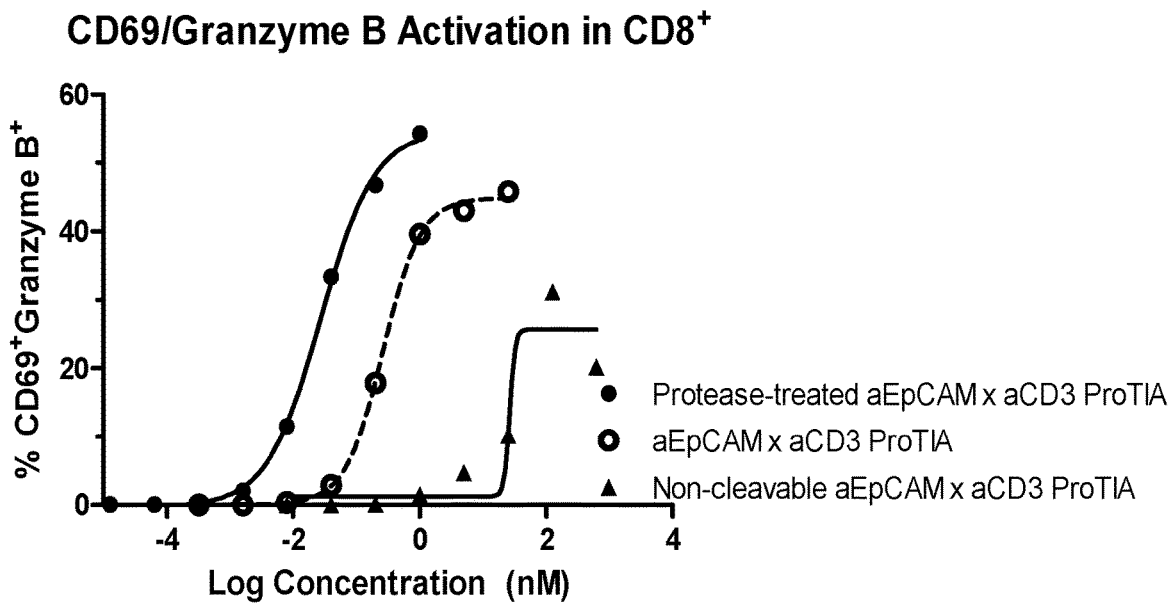
FIG. 49B
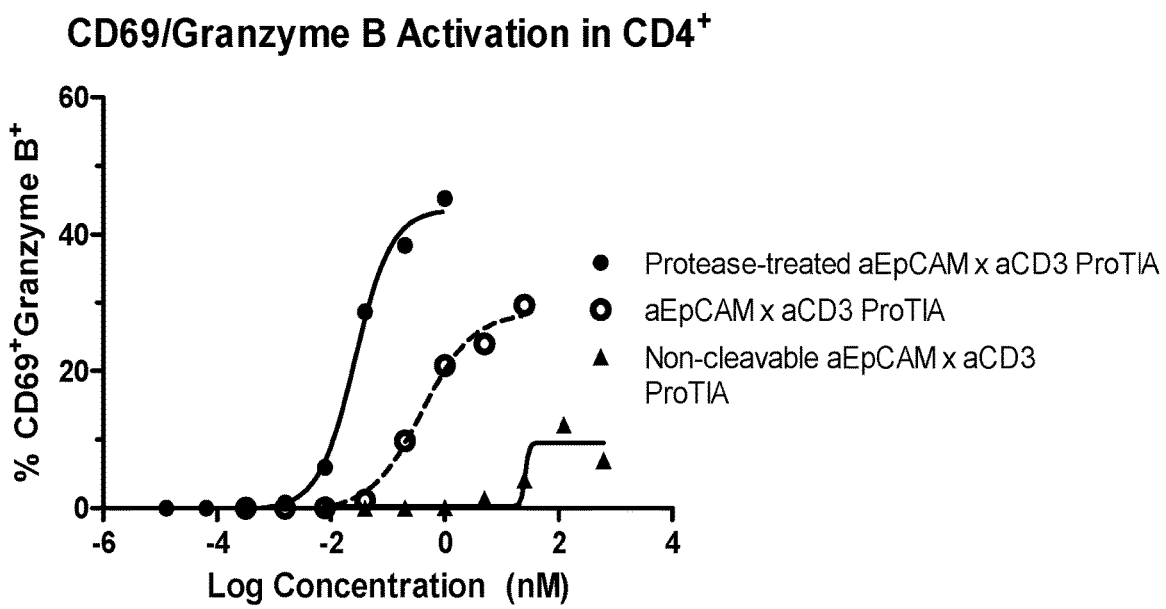
FIG. 49

FIG. 50A
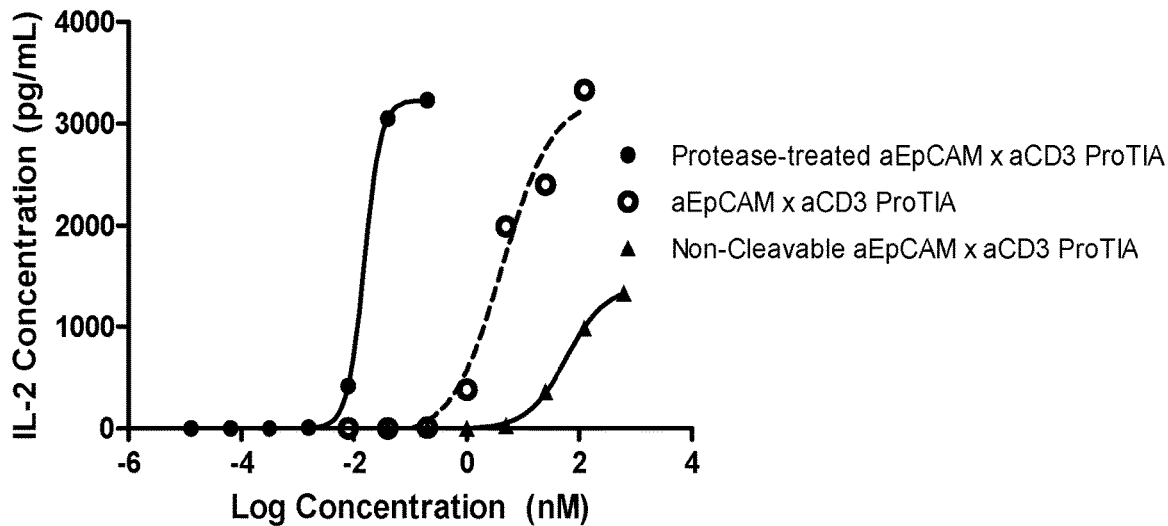
FIG. 50B
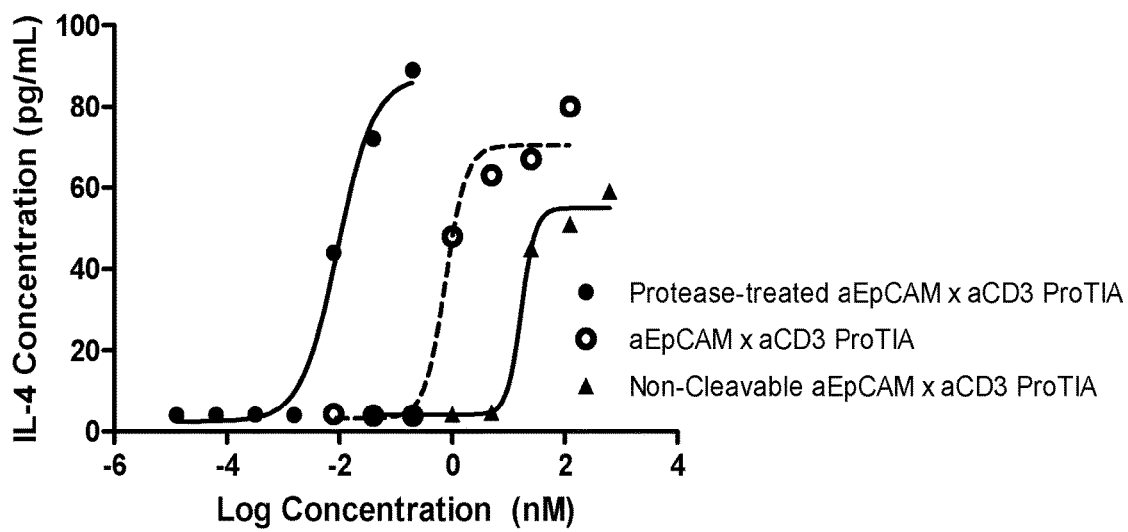
FIG. 50

FIG. 51A
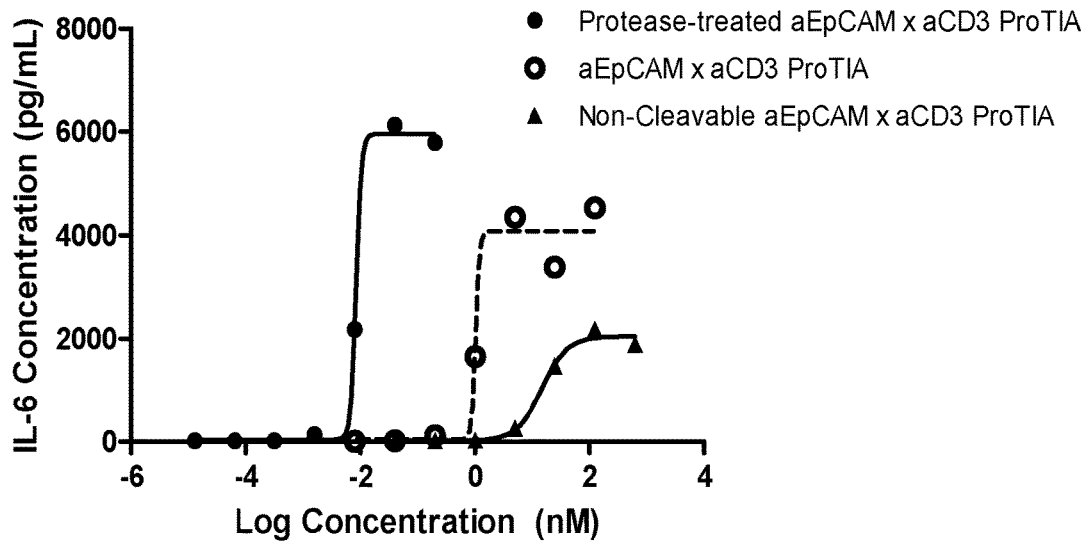
FIG. 51B
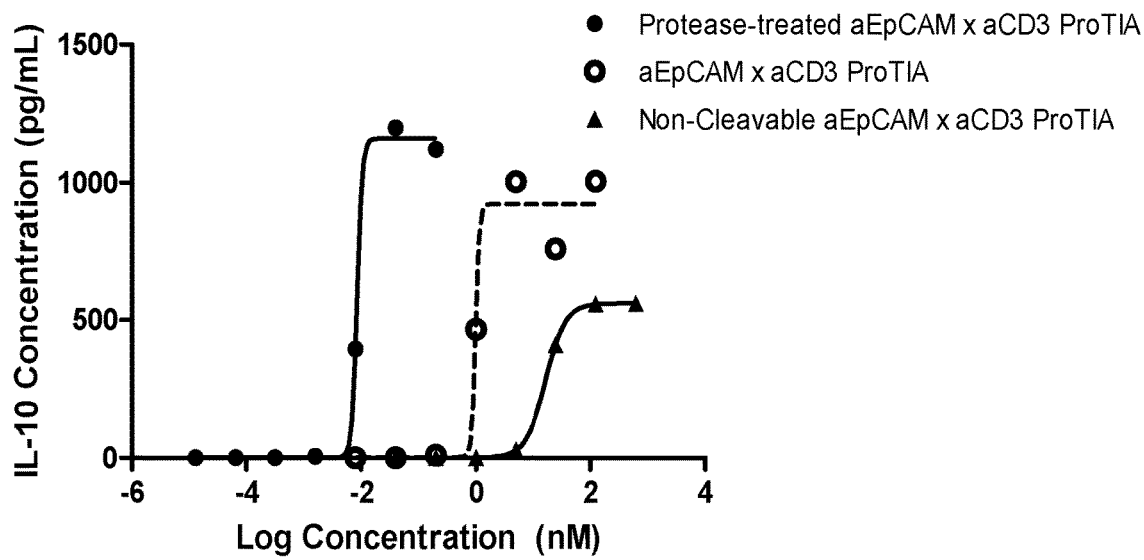
FIG. 51

FIG. 52A
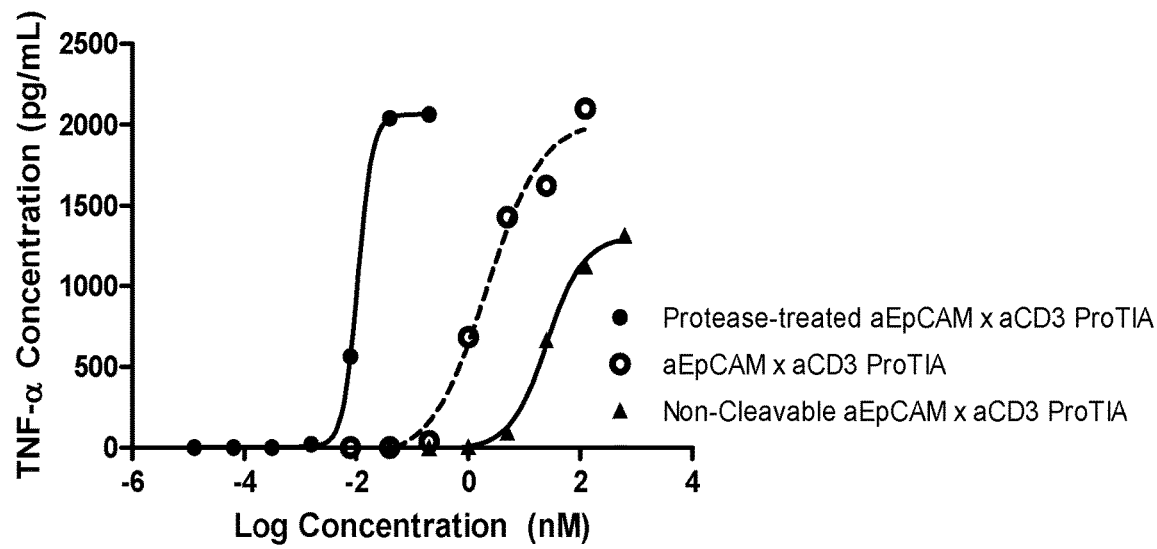
FIG. 52B
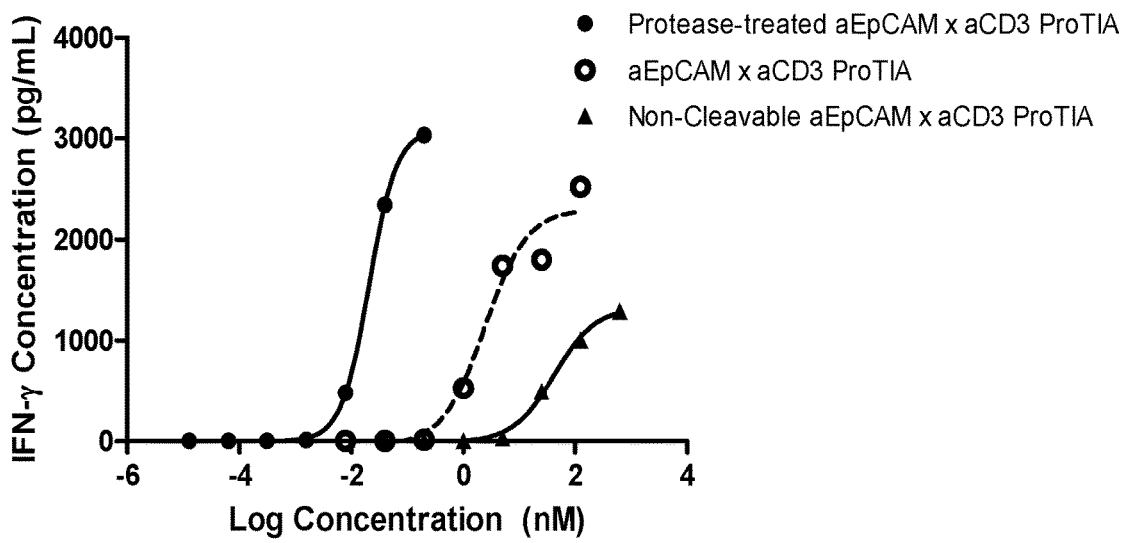
FIG. 52

- ■ Protease-treated aHER2 x aCD3 ProTIA on HER2 coated on plate
- ▲ Protease-treated aCEA x aCD3 ProTIA on CEA coated on plate
- ● Protease-treated aEpCAM x aCD3 ProTIA on EpCAM coated on plate
- ○ Protease-treated aEpCAM x aCD3 ProTIA on HER2 coated on plate
- ⊗ Protease-treated aEpCAM x aCD3 ProTIA on CEA coated on plate

FIG. 69A
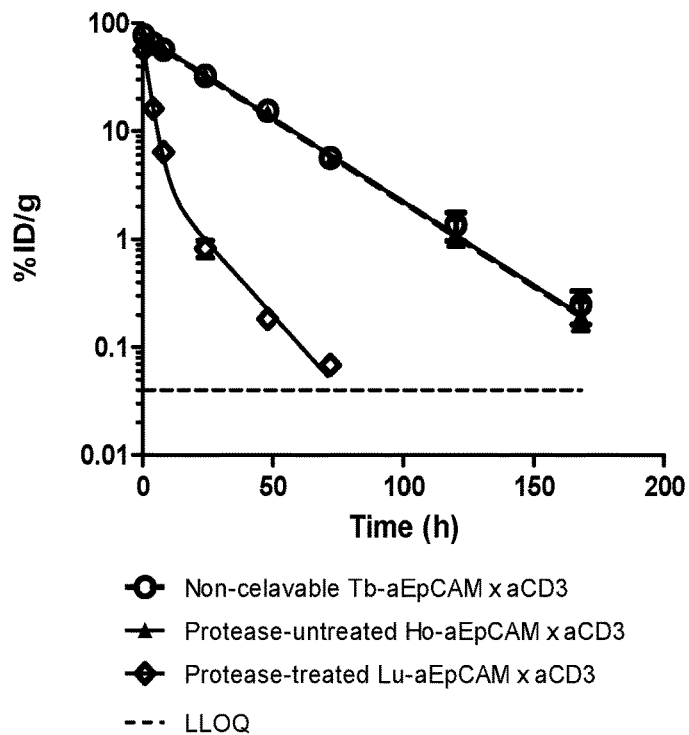
FIG. 69B
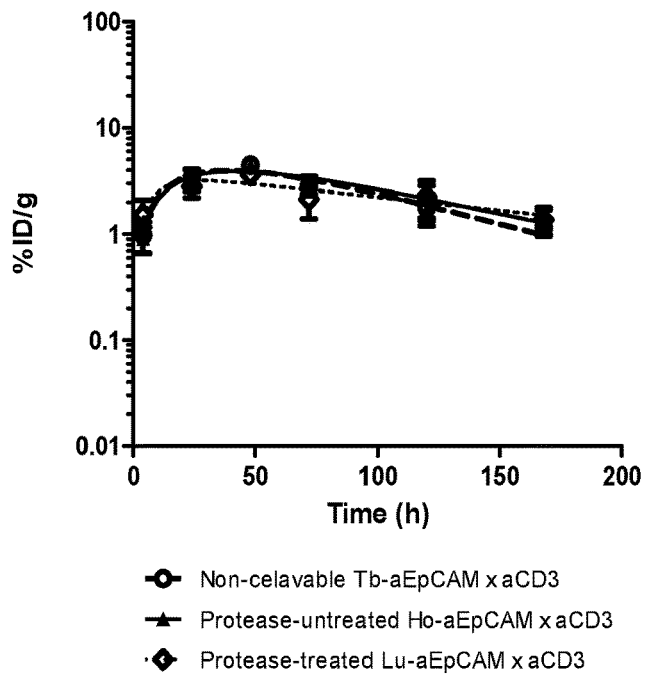
FIG. 69

FIG. 70A
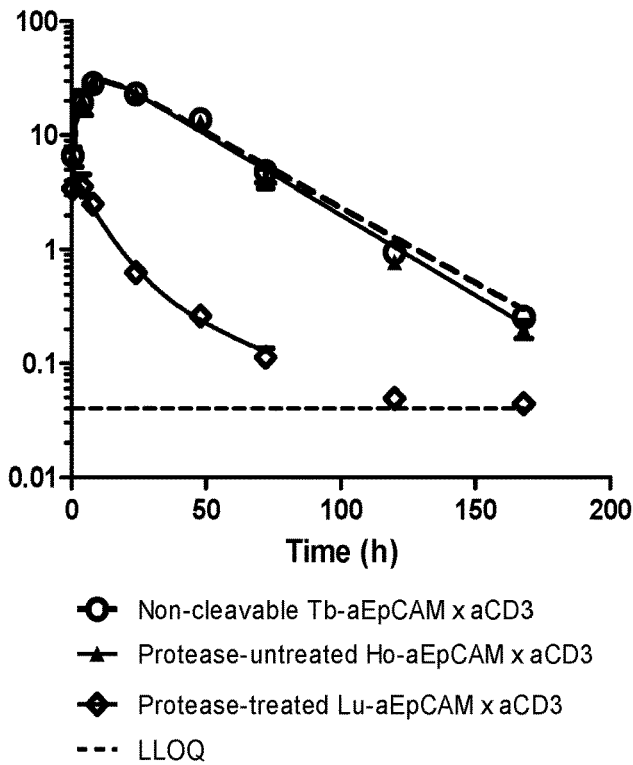
FIG. 70B
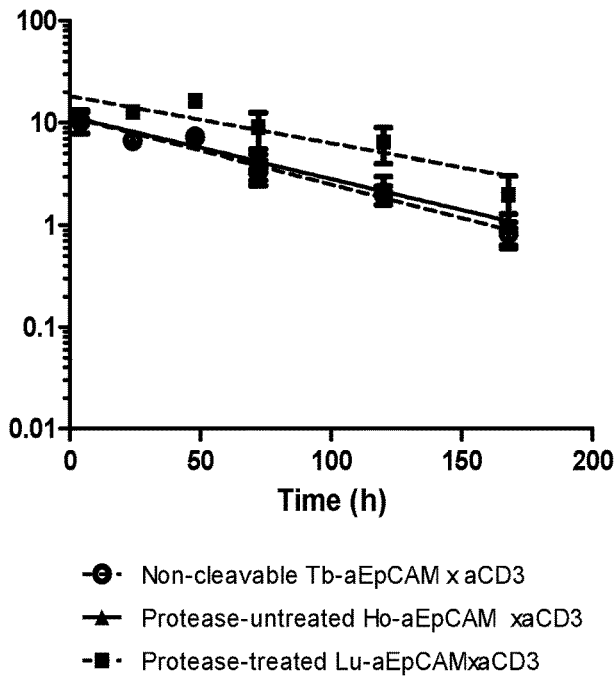
FIG. 70

FIG. 71A
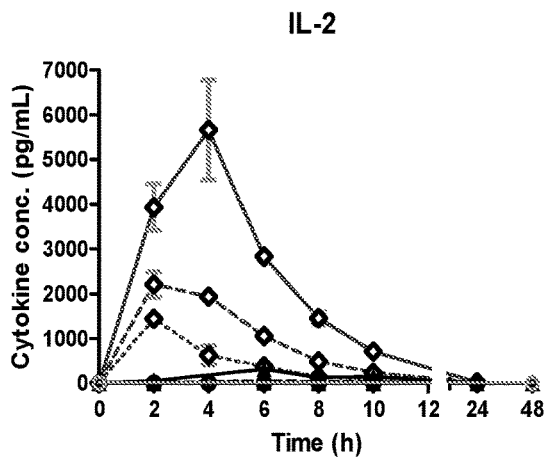
FIG. 71B
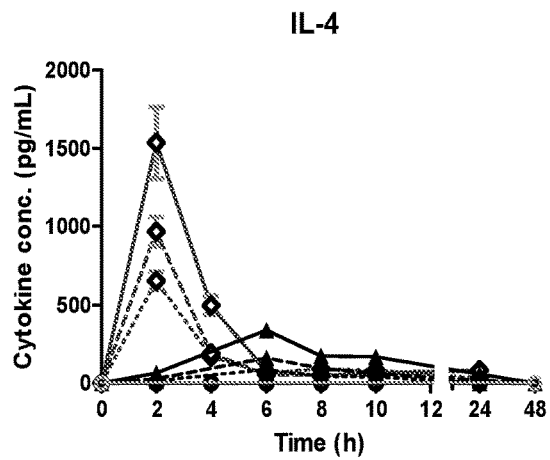
FIG. 71C
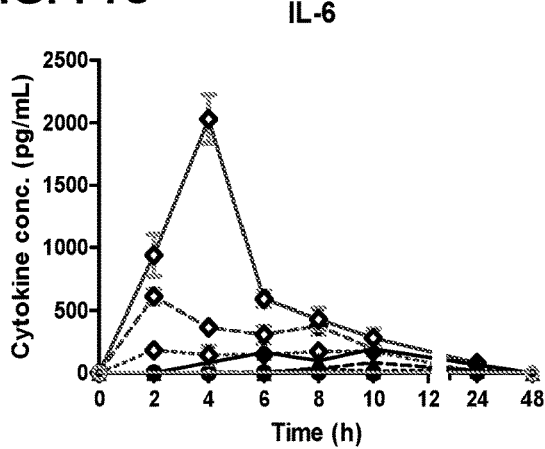
FIG. 71D
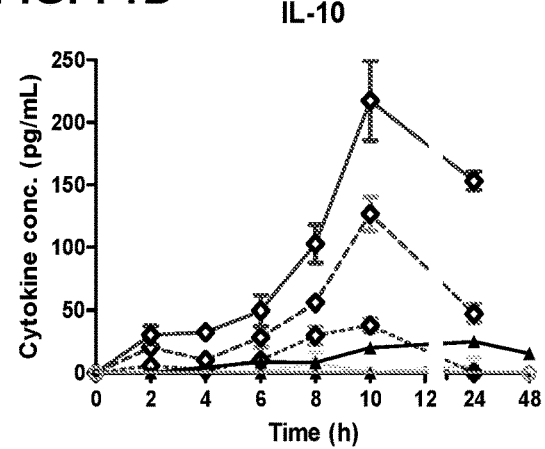
FIG. 71E
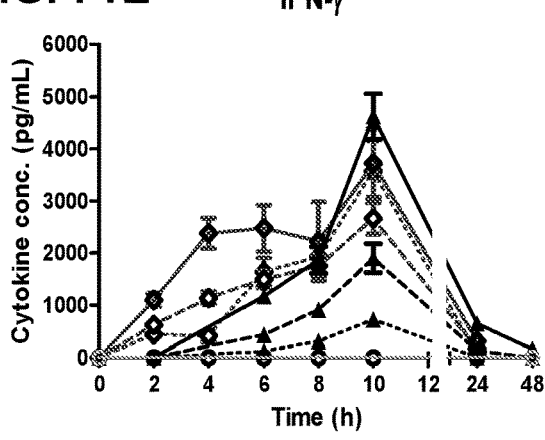
FIG. 71F
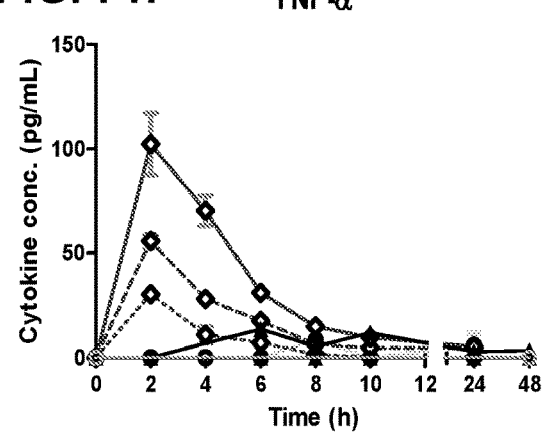
–○– Control AC1476A 500 ug/kg
·◇· AC1553A 50 ug/kg
–◇– AC1553A 150 ug/kg
–◇– AC1553A 500 ug/kg
·▲· AC1553X 120 ug/kg
–▲– AC1553X 360 ug/kg
–▲– AC1553X 1,200 ug/kg
FIG. 71

FIG. 73A
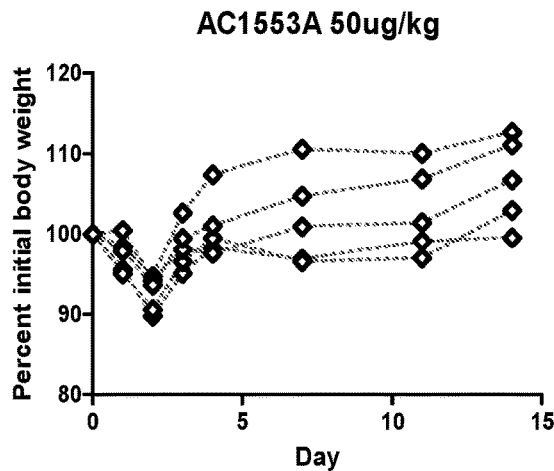
FIG. 73D
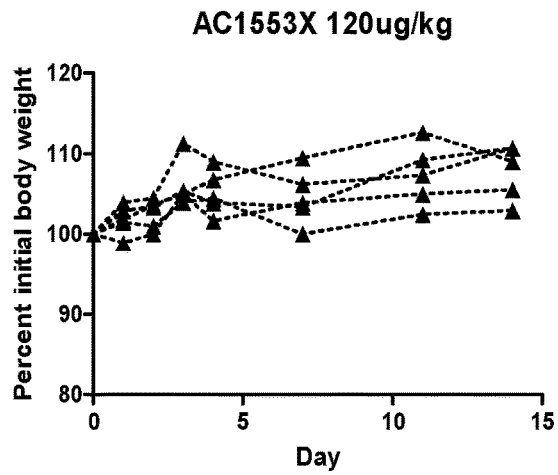
FIG. 73B
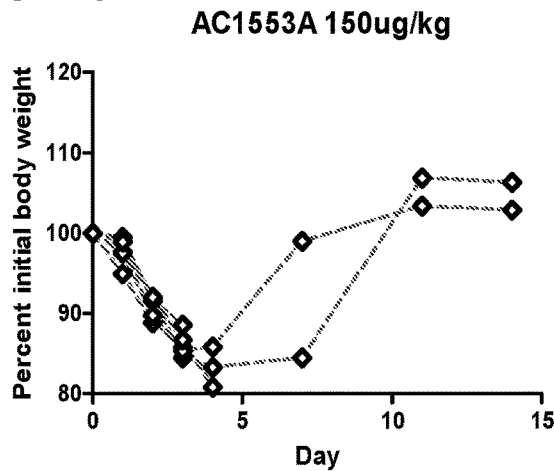
FIG. 73E
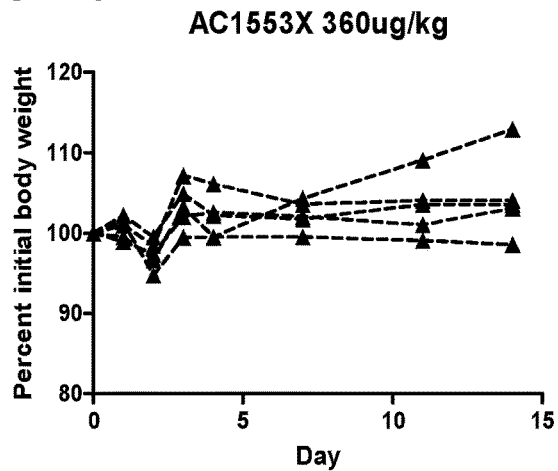
FIG. 73C
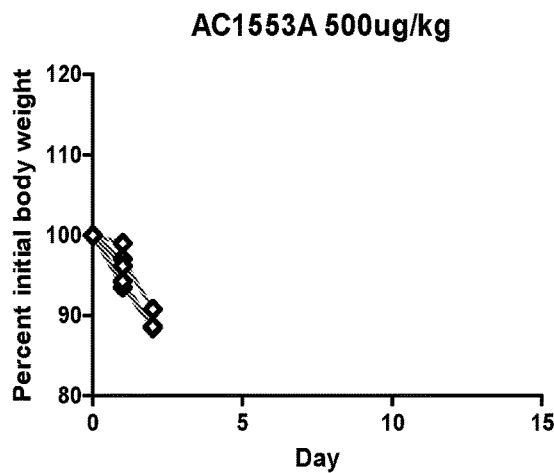
FIG. 73F
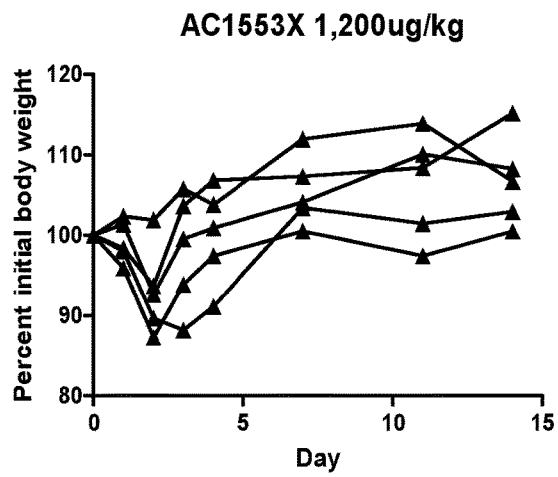
FIG. 73

FIG. 74A
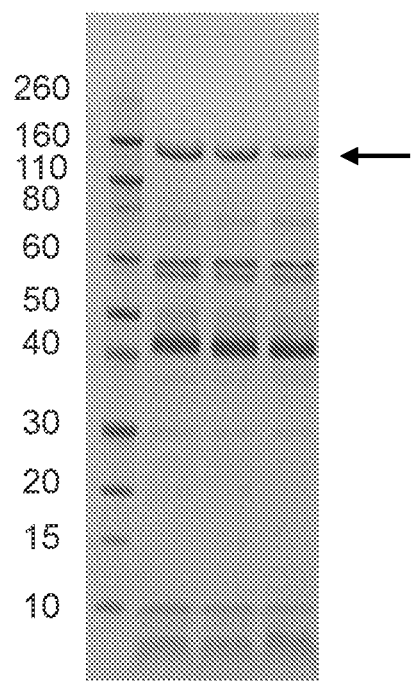
FIG. 74B
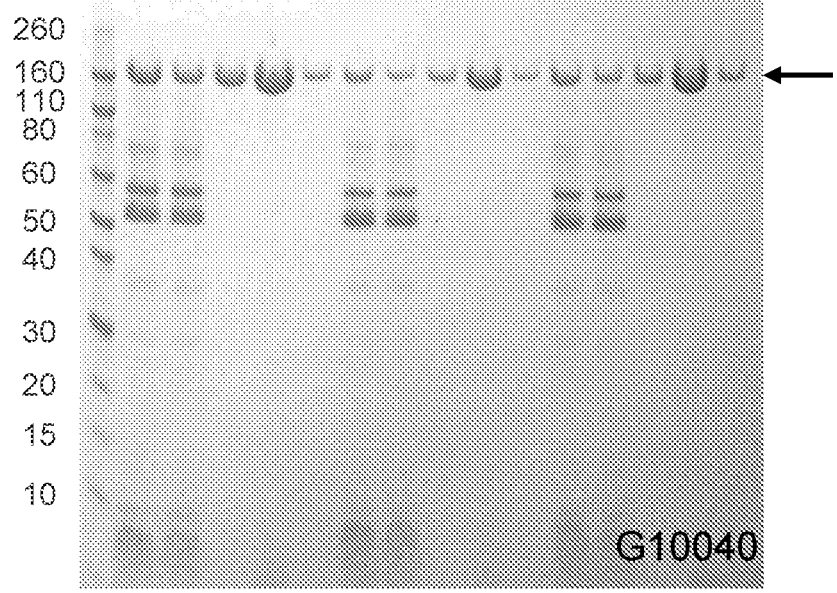
FIG. 74

FIG. 74C
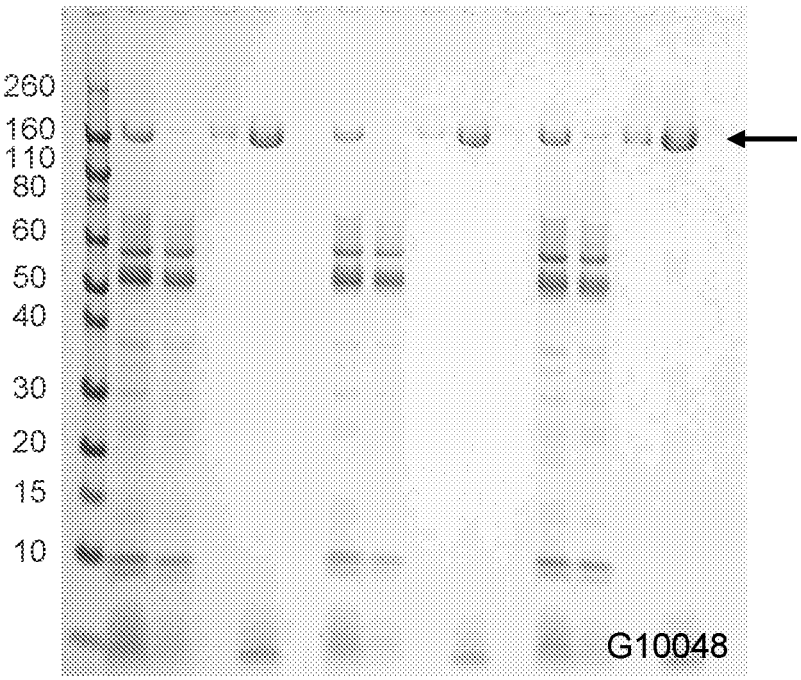
FIG. 74D
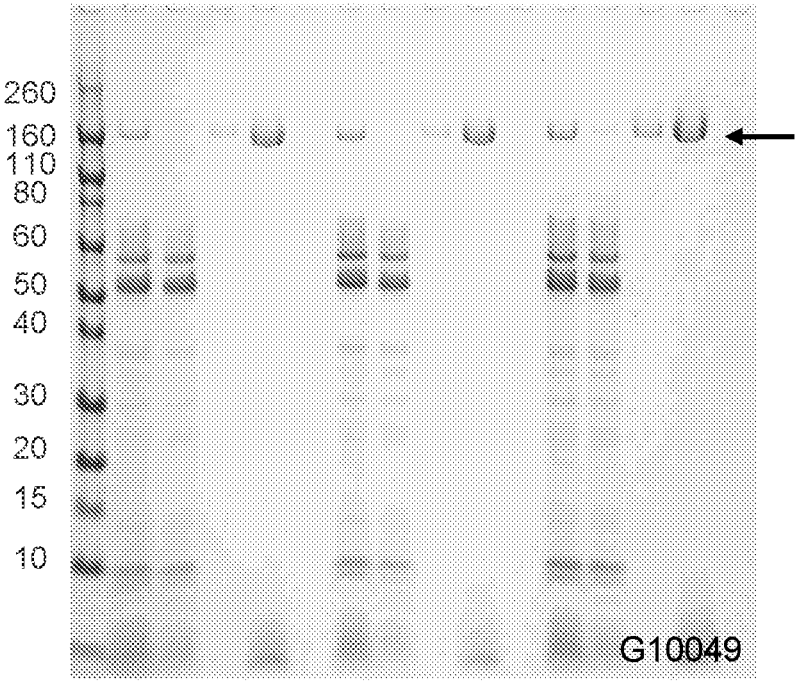
FIG. 74

FIG. 79A
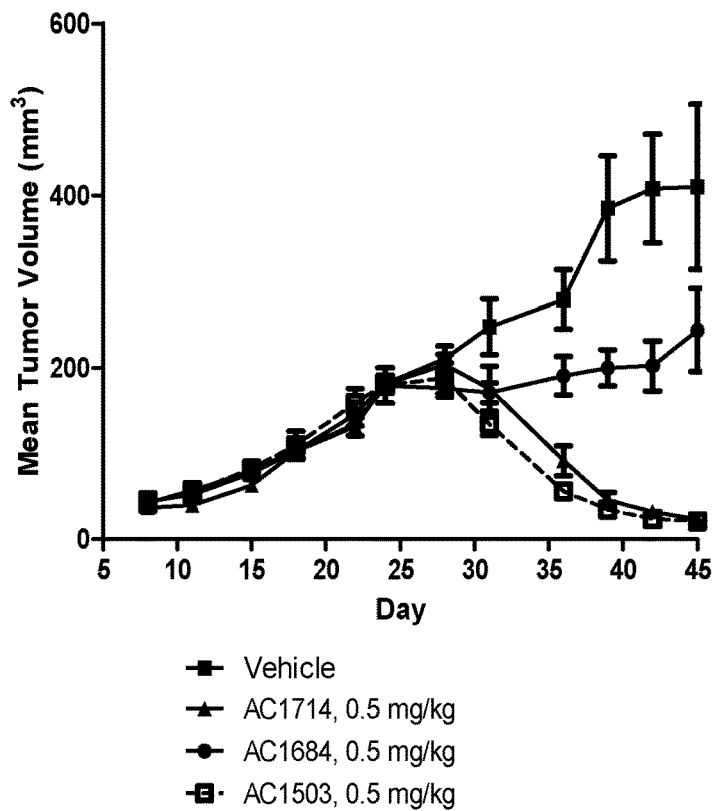
FIG. 79B
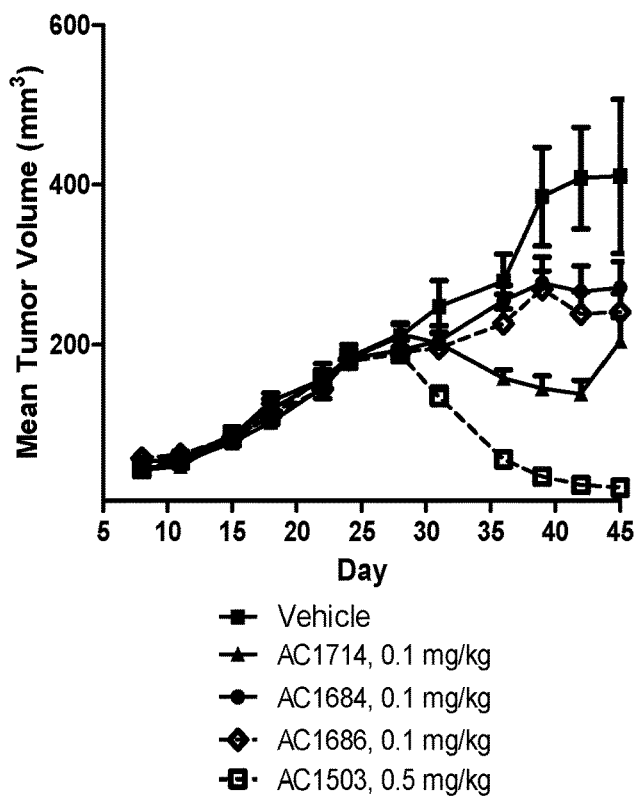
FIG. 79

FIG. 80A
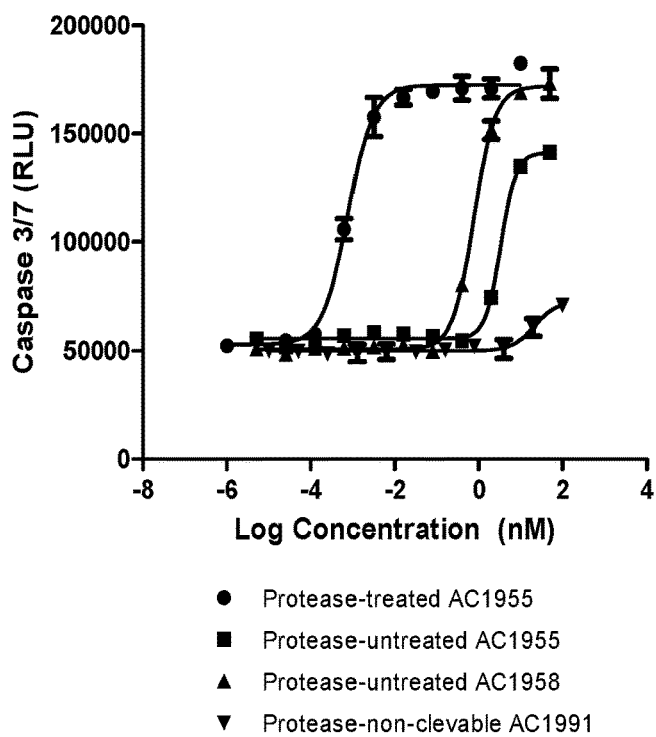
- Protease-treated AC1955
- Protease-untreated AC1955
- Protease-untreated AC1958
- Protease-non-clevable AC1991
FIG. 80B
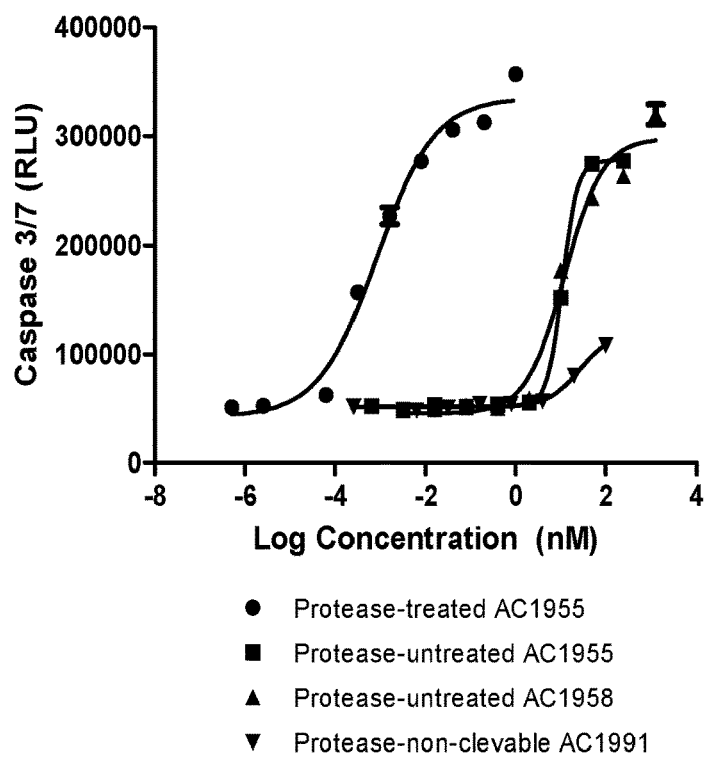
- Protease-treated AC1955
- Protease-untreated AC1955
- Protease-untreated AC1958
- Protease-non-clevable AC1991
FIG. 80

FIG. 81A
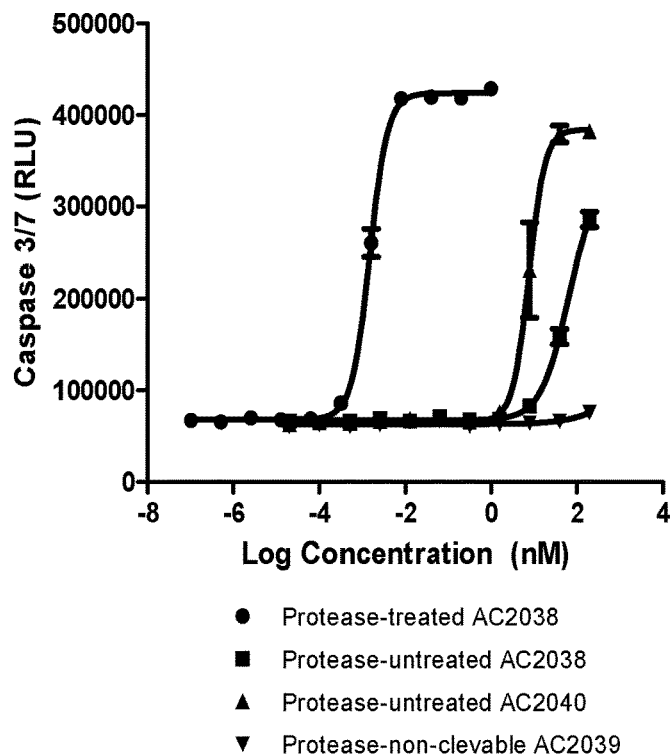
- ● Protease-treated AC2038
- ■ Protease-untreated AC2038
- ▲ Protease-untreated AC2040
- ▼ Protease-non-clevable AC2039
FIG. 81B
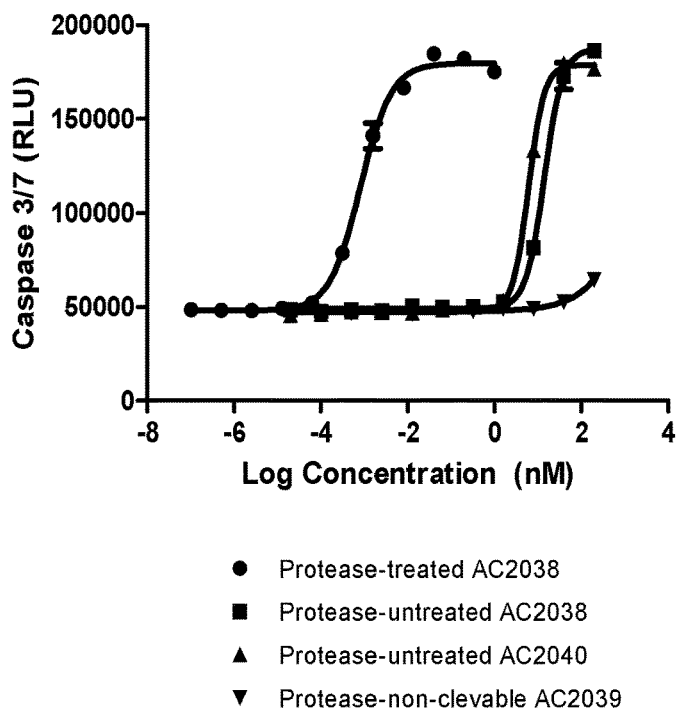
- ● Protease-treated AC2038
- ■ Protease-untreated AC2038
- ▲ Protease-untreated AC2040
- ▼ Protease-non-clevable AC2039
FIG. 81

FIG. 81C
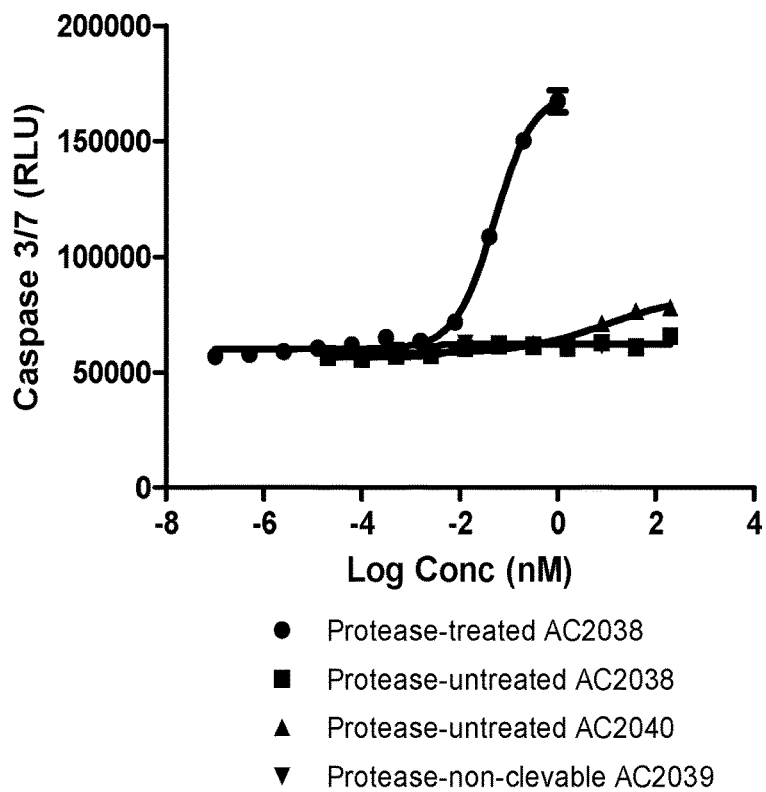
- Protease-treated AC2038
- Protease-untreated AC2038
- Protease-untreated AC2040
- Protease-non-clevable AC2039
FIG. 81D
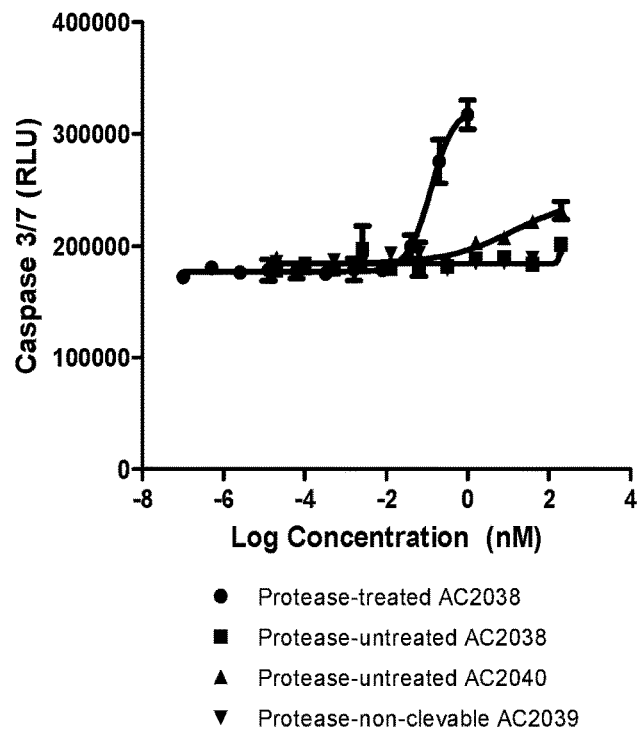
- Protease-treated AC2038
- Protease-untreated AC2038
- Protease-untreated AC2040
- Protease-non-clevable AC2039
FIG. 81

FIG. 82A
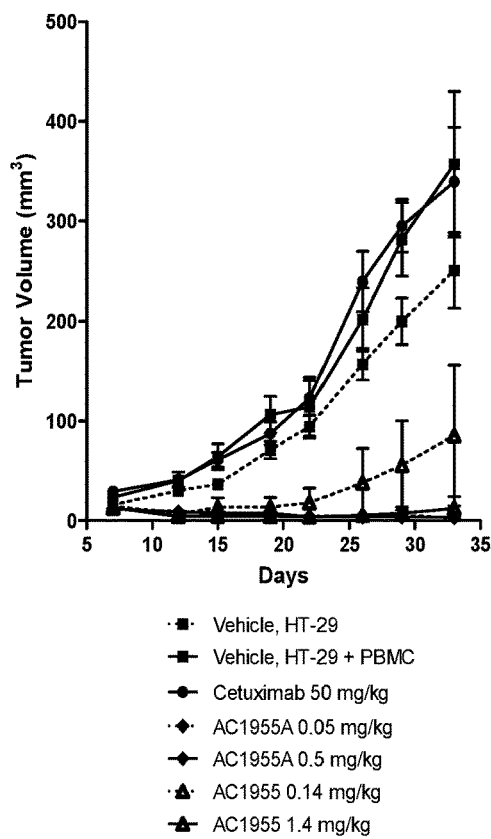
FIG. 82B
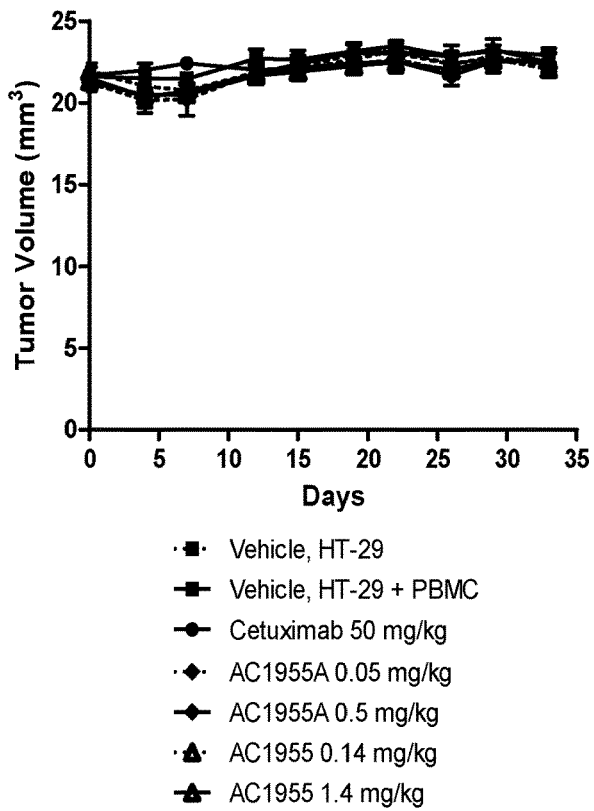
FIG. 82

FIG. 83A
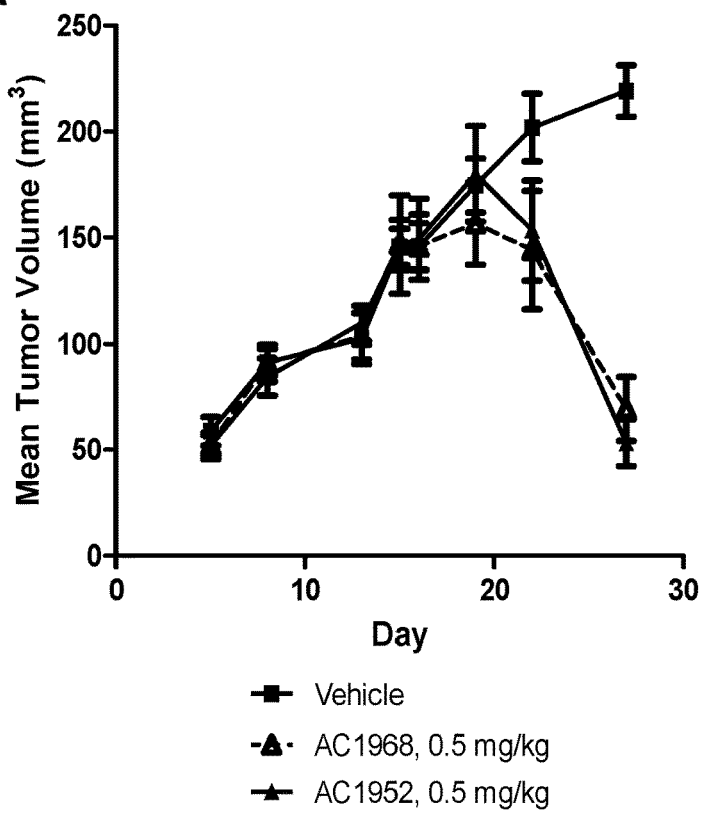
FIG. 83B
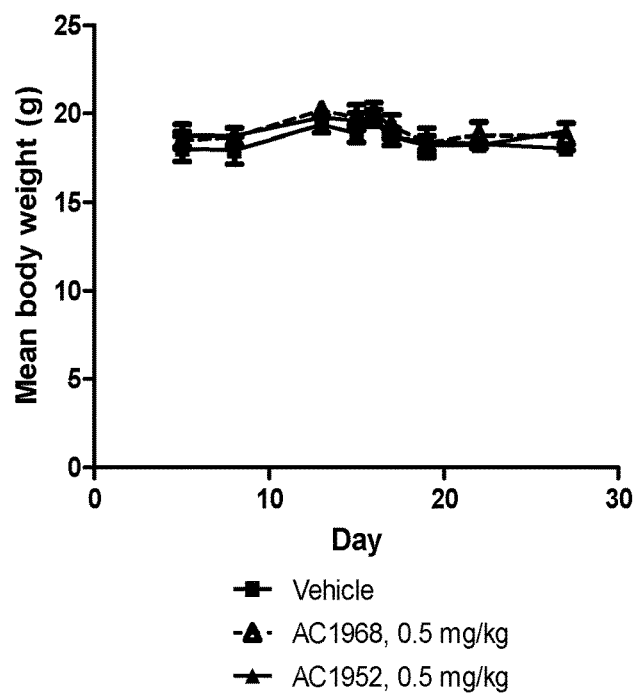
FIG. 83

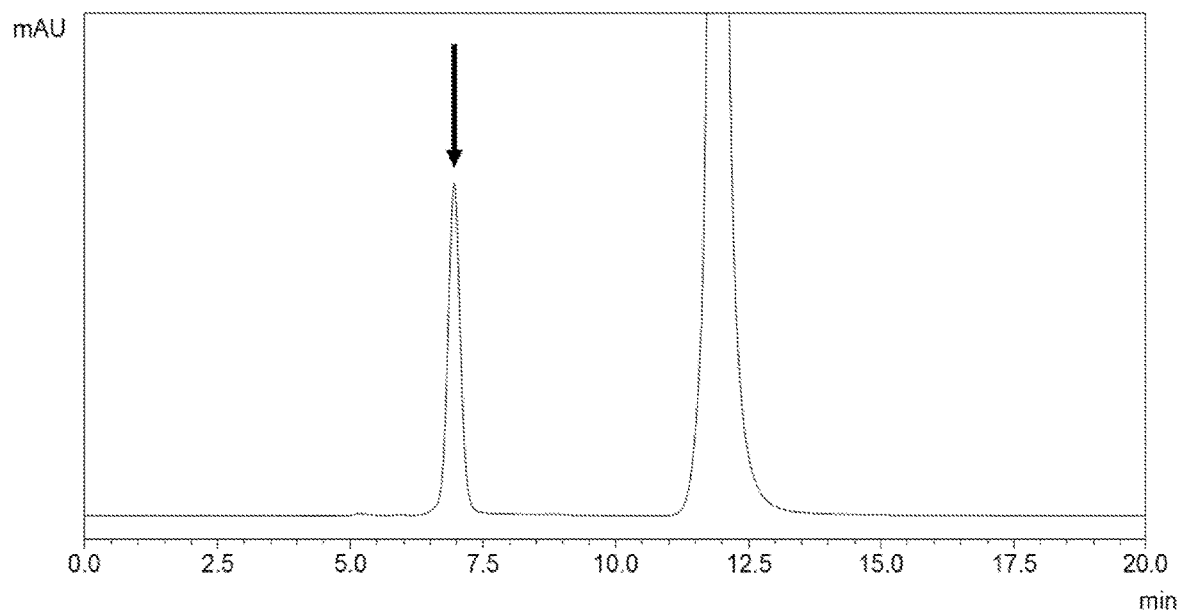
FIG. 85A
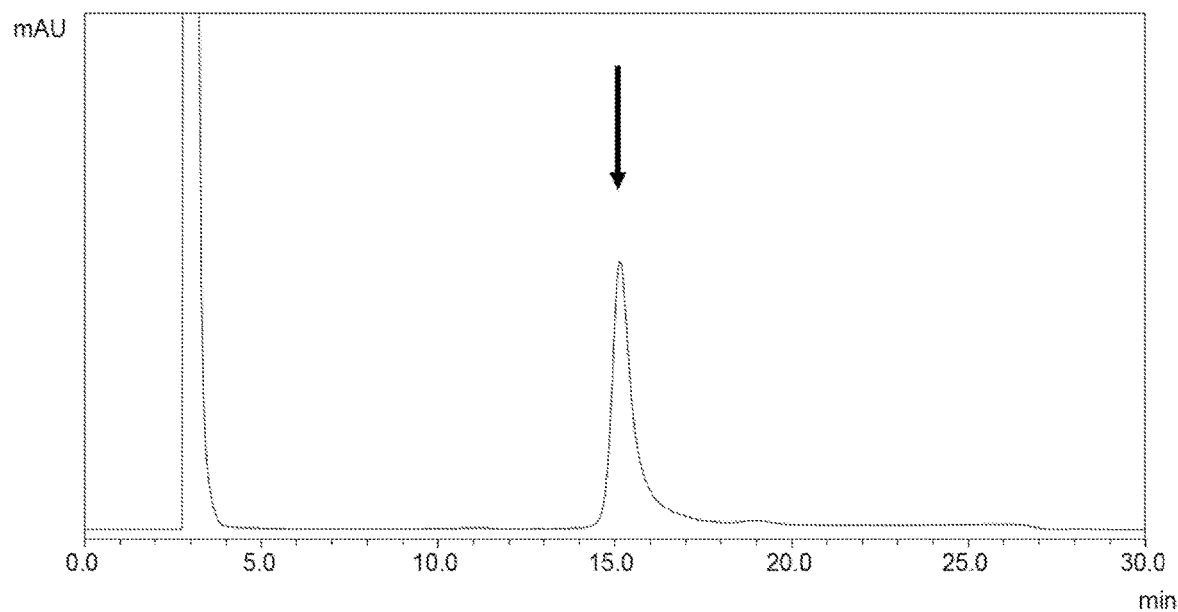
FIG. 85B
FIG. 85

FIG. 86A
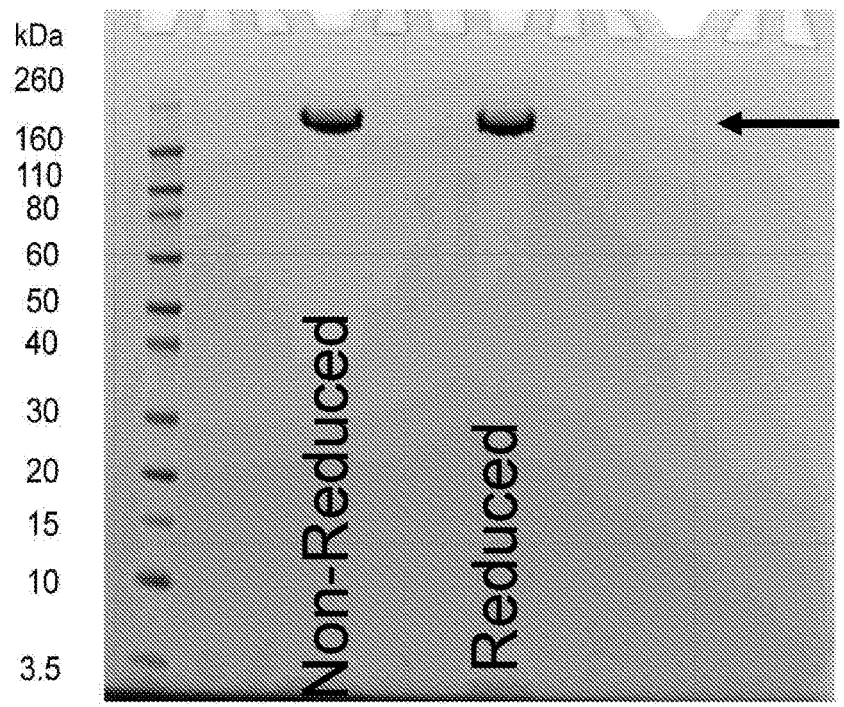
Lane  1  2  3  4  5  6  7  8  9  10  11  12
FIG. 86B
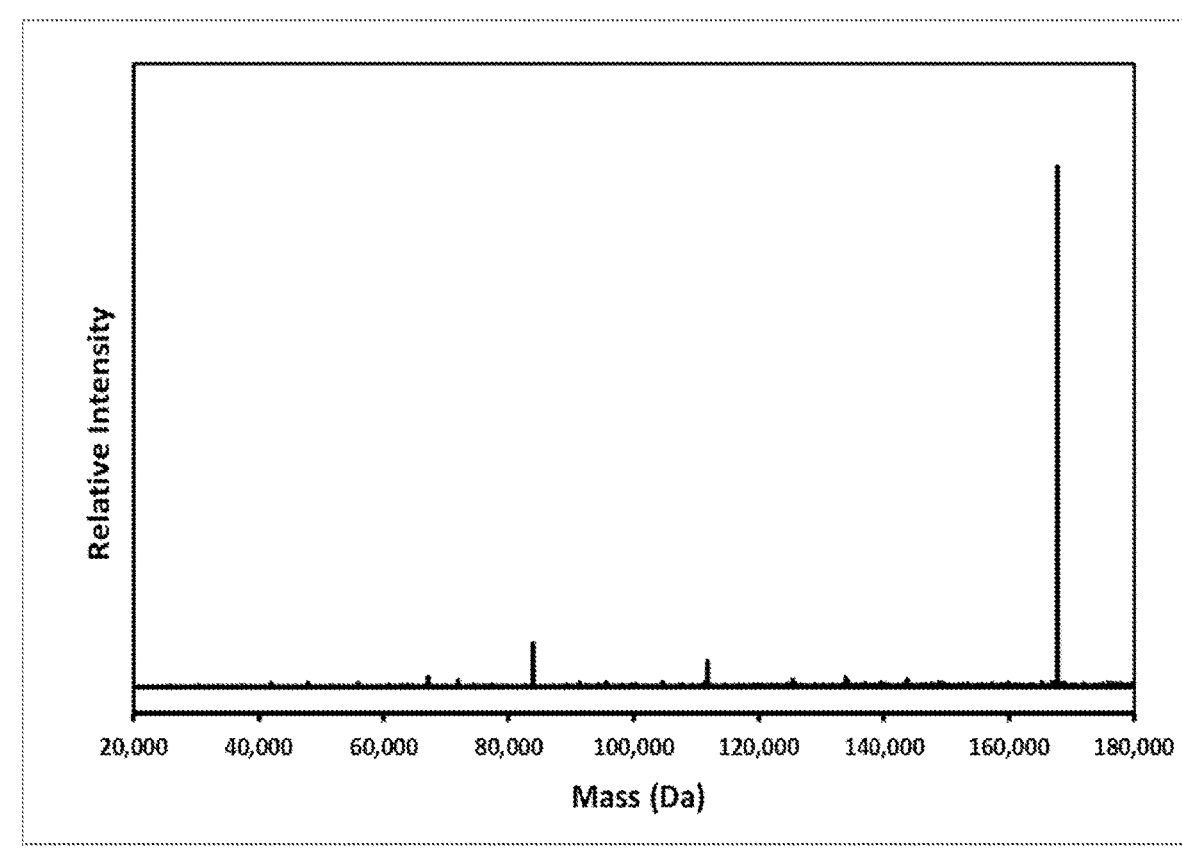
FIG. 86

FIG. 87A
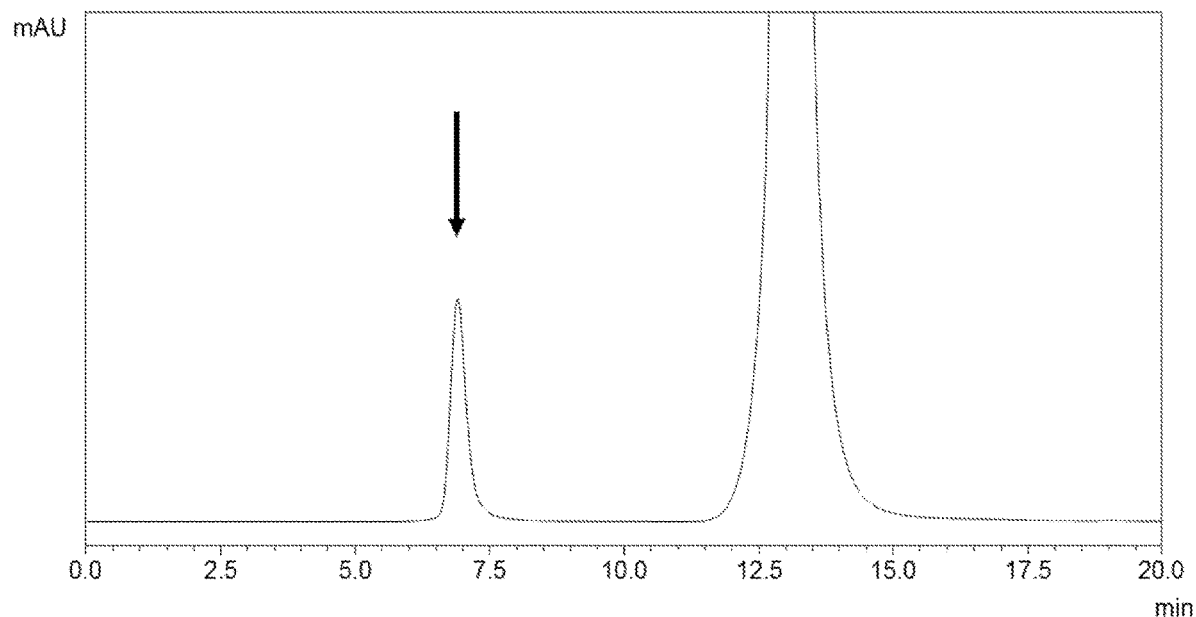
FIG. 87B
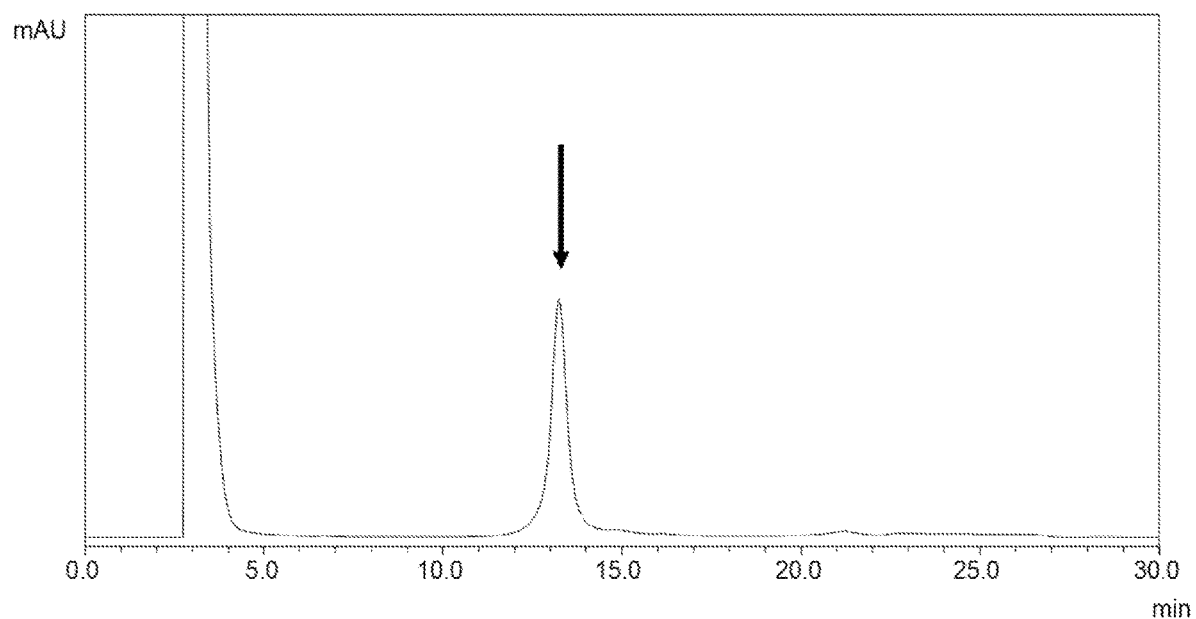
FIG. 87

RELEASE SEGMENTS AND BINDING COMPOSITIONS COMPRISING SAME

CROSS-REFERENCE TO RELATED APPLICATIONS

This present application is a U.S. National Phase Application pursuant to 35 U.S.C. § 371 of International Application No. PCT/US2018/066939, filed Dec. 20, 2018, which claims priority to U.S. Provisional Application Ser. No. 62/609,296 filed on Dec. 21, 2017 and U.S. Provisional Application Ser. No. 62/780,719 filed Dec. 17, 2018, which are hereby incorporated by reference in their entireties.

REFERENCE TO AN ELECTRONIC SEQUENCE LISTING

The instant application contains a Sequence Listing which has been submitted electronically as a text file in ASCII and is hereby incorporated by reference in its entirety pursuant to 37 C.F.R. § 1.821. The name of the ASCII text file is "20-1839-WO—US_Sequence_Listing.txt", was created on Jan. 14, 2019, and is 1.81 MB in size.

BACKGROUND OF THE INVENTION

A primary goal of cancer therapy is to specifically destroy tumor cells, while leaving healthy cells and tissues as undamaged as possible. An approach that has recently generated interest is to induce an immune response against the tumor in which immune effector cells such as natural killer (NK) cells or cytotoxic T lymphocytes (CTLs) are induced to attack and destroy tumor cells.

While the use of intact monoclonal antibodies (MAb) with affinity for a tumor-associated antigen have been successfully applied in the area of cancer therapy, the large size of intact MAbs, which results in poor bio-distribution, together with their long persistence in the blood pool, limit their utility. In addition, due to tumor necrosis and inhomogeneous antigen distribution, it is often not possible to reach the central portions of a tumor with intact MAbs. To overcome this, the use of smaller antibody fragments can result in rapid tumor localization and deeper penetration into the tumor, as well as rapid removal from the bloodstream. To this end, single chain fragments (scFv) derived from MAb offer better biodistribution than intact MAbs and can target tumor cells more efficiently. Despite the advantages of scFv, use of monospecific scFv hampers their full clinical deployment in cancer chemotherapy for targets commonly expressed by both diseased and healthy tissue. To overcome this and other disadvantages, the use of specifically-designed bispecific antibodies offers a different approach in that they can be designed to direct immune effector cells to kill cancer cells. Bispecific antibodies combine the benefits of different binding specificities derived from two monoclonal antibodies into a single composition, enabling approaches or combinations of coverages that are not possible with monospecific antibodies. This approach relies on binding of one arm of the bispecific antibody to a tumor-associated antigen or marker, while the other arm, upon binding the marker of an effector cell (e.g., a CD3 molecule on T cells), triggers their cytotoxic activity by the release of effector molecules such as such as TNF-alpha, IFN-gamma, interleukins 2, 4 and 10, perform, and granzymes. Advances in antibody engineering have led to the development of a number of bispecific antibody formats and compositions for redirecting effector cells to tumor targets, including Bi-specific T-cell Engagers (BiTEs®) such as blinatumomab. BiTEs function by recruiting and activating polyclonal populations of T-cells at tumor sites, and do so without the need for co-stimulation or conventional MHC recognition. There remains, however, the dual problems of certain patients experiencing serious side effects referred to as "cytokine storm" or "cytokine release syndrome" (Lee D W et al. Current concepts in the diagnosis and management of cytokine release syndrome. Blood. 2014 124(2):188-195) mediated by the release of TNF-alpha and IFN-gamma, amongst other cytokines, in addition to the fact that BiTE compositions have a very short half-life, necessitating continuous infusions of four to eight weeks in order to maintain BiTE within the therapeutic window for sufficient time to achieve a therapeutic effect.

Proteases are enzymes that are capable of cleaving proteins and peptides by hydrolysis of peptide bonds. Proteases are involved in a diversity of functions, regulate the fate and activity of many proteins, create or inactivate bioactive molecules, affect cell proliferation and differentiation, tissue morphogenesis and remodeling, contribute to the processing of protein, and even are involved in molecular signaling. As a result of the action of proteases and protein responses, they play a role in angiogenesis, wound repair, hemostasis, blood coagulation, inflammation, immunity, necrosis, apoptosis, and the progression or amelioration of diseases, including cancers. As an example, studies have shown the value of matriptase as a prognostic marker in various human cancers. In prostate and cervical cancer, matriptase mRNA and protein are up-regulated in cancerous lesions compared with normal tissue, and there is a positive correlation between matriptase expression and histopathological grade of the tumor (Lee J W, et al. Increased expression of matriptase is associated with histopathologic grades of cervical neoplasia. Hum Pathol. (2005) 36(6):626-33). While matriptase is expressed at low levels in the normal ovary, it becomes highly expressed in early-stage ovarian carcinoma (Tanimoto H., et al., Transmembrane serine protease TADG-15 (ST14/Matriptase/MT-SP1): expression and prognostic value in ovarian cancer. Br J Cancer. (2005) 92(2):278-83). Similarly, matrix metalloproteinases (MMPs) are important cancer markers in that they are present in nearly all human cancers. MMPs can be expressed by healthy fibroblasts in the stroma adjacent to tumors, cancer-associated fibroblasts, or by non-fibroblastic cancer cells where they can influence the tumor environment by promoting angiogenesis, tumor growth, and metastasis (Bhowmick, N. A., Stromal fibroblasts in cancer initiation and progression. Nature, 432 (2004), pp. 332-337). Similarly, legumain is overexpressed in the majority of human solid tumors (Liu, C., et al. Overexpression of Legumain in Tumors Is Significant for Invasion/Metastasis and a Candidate Enzymatic Target for Prodrug Therapy. Cancer Res. (2003) 63(11):2957-2964). An essential function of tumor proteases is to dissolve the extracellular matrix to allow the tumor cells to invade, and grow in an infiltrative manner in, normal tissue. These proteases also protect the tumor from the defense mechanisms of the body by cleaving and inactivating, for example, antibodies, cytokines, growth factors, complement factors, coagulation factors and mediators that would limit otherwise inhibit the tumor. Because of the presence of these cancer-associated proteases, it is now recognized that there is a need to design activatable bispecific antibody fragment compositions that are selectively activated in the vicinity of the cancer or tumor cell proteases, resulting in the ability to direct effector cells to cancer cell targets and effect the killing of the cells.

Because protease-sensitive peptides can be incorporated into therapeutic biologics to confer certain properties on the intact and/or the product of a protease-treated drug or biologic, there exists a need to identify new peptide substrates for proteases associated with diseased tissues and to incorporate these peptide substrates in a variety of prodrug therapeutic, diagnostic and prophylactic compositions as a key mechanism to activate such compositions, improving the therapeutic index and outcome.

SUMMARY OF THE INVENTION

There remains a considerable need for alternative therapeutics that offer the pharmacologic advantages of bispecific antibody formats but with increased safety, reduced side effects, increased selectivity, and/or enhanced pharmaceutical or pharmacokinetic properties, such as route of administration, requiring less frequent dosing or merely dosing by a single injection.

The present disclosure provides recombinant polypeptides comprising cleavable release segments (RS) that are useful in the treatment or prevention of diseases, including but not limited to cancers, autoimmune, and inflammatory disorders. The recombinant polypeptides comprising release segments described herein may address an unmet need and are superior in one or more aspects, including tailored designs that result in beneficial properties described herein.

In a first aspect, the disclosure provides recombinant polypeptides comprising a first release segment (RS1), wherein the RS1 is a substrate for cleavage by a mammalian protease. In one embodiment, the RS1 comprises an amino acid sequence having at least 88%, or at least 89%, or at least 90%, or at least 91%, or at least 92%, or at least 93%, or at least 94%, or at least 95%, or at least 100% sequence identity to a sequence selected from the sequences set forth in Table 1, wherein the RS1 is a substrate for one or more mammalian proteases. In another embodiment, the RS1 comprises an amino acid sequence having at least 88%, or at least 89%, or at least 90%, or at least 91%, or at least 92%, or at least 93%, or at least 94%, or at least 95%, or at least 96%, or at least 97%, or at least 100% sequence identity to a sequence selected from the sequences set forth in Table 2, wherein the RS1 is a substrate for one or more mammalian proteases. In another embodiment, the RS1 comprises an amino acid sequence selected from the sequences of Table 1, wherein the RS1 is a substrate for one or more mammalian proteases. In another embodiment, the RS1 comprises an amino acid sequence selected from the sequences of Table 2, wherein the RS1 is a substrate for one or more mammalian proteases.

In another aspect, the present disclosure provides recombinant polypeptides comprising an RS1 and further comprising a first binding moiety (FBM) having binding affinity for a target cell marker on a target tissue or cell. In one embodiment, the FBM is an antibody, a cytokine, a cell receptor, or a fragment thereof. In one embodiment in which the recombinant polypeptide comprises an RS1 and a FBM, the RS1 is a substrate for cleavage by a mammalian protease wherein the mammalian protease is produced by or is co-localized with the target tissue or cell. In another embodiment in which the recombinant polypeptide comprises an RS1 and a FBM, the RS1 is a substrate for cleavage by multiple mammalian proteases wherein the mammalian proteases are produced by or are co-localized with the target tissue or cell. The RS1 of the subject compositions can be a substrate for a serine protease and/or a cysteine protease and/or a metalloproteinase. In one embodiment, the RS1 is a substrate for a protease selected from legumain, MMP-2, MMP-7, MMP-9, MMP-11, MMP-14, uPA, and matriptase. In another embodiment, the RS1 is a substrate for a protease set forth in Table 3. In some embodiments, the RS1 of the embodiments is designed for cleavage by multiple proteases at one, two, or three cleavage sites in the RS1 sequence. In one embodiment of the foregoing, the RS1 is a substrate for cleavage at two or more cleavage sites by two or more proteases selected from legumain, MMP-2, MMP-7, MMP-9, MMP-11, MMP-14, uPA, and matriptase. In another embodiment of the foregoing, the RS1 is a substrate for cleavage at three or more cleavage sites by three or more proteases selected from legumain, MMP-2, MMP-7, MMP-9, MMP-11, MMP-14, uPA, and matriptase.

In a particular feature, the release segments of the subject compositions can be designed to have different rates of cleavage by the mammalian proteases at each of the cleavage sites. In the design of the release segments, the rates of cleavage were determined relative to a control release segment having the amino acid sequence EAGRSANHEPLGLVAT (SEQ ID NO.: 1), which can be cleaved by serine, cysteine and metalloproteinases, as described in Example 43. In one embodiment, the disclosure provides recombinant polypeptides comprising an RS1 and a FBM, wherein the rate of cleavage of the RS1 by legumain, MMP-2, MMP-7, MMP-9, MMP-11, MMP-14, uPA, or matriptase is at least two-fold faster compared to the rate of cleavage of the control sequence having the sequence EAGRSANHEPLGLVAT (SEQ ID NO.: 1) by the same protease when assayed in vitro under equivalent molar concentrations. In another embodiment, the disclosure provides recombinant polypeptides comprising an RS1 and a FBM, wherein the rate of cleavage of the RS1 by legumain, MMP-2, MMP-7, MMP-9, MMP-11, MMP-14, uPA, or matriptase is at least two-fold slower compared to the rate of cleavage of the control sequence having the sequence EAGRSANHEPLGLVAT (SEQ ID NO.: 1) by the same protease when assayed in vitro under equivalent molar concentrations. In another embodiment, the disclosure provides recombinant polypeptides comprising an RS1 and a FBM, wherein the RS1 is a substrate for cleavage by a protease selected from legumain, MMP-2, MMP-7, MMP-9, MMP-11, MMP-14, uPA, or matriptase and wherein the RS1 has at least a 0.2 $\log_2$, or 0.4 $\log_2$, or 0.8 $\log_2$, or 1.0 $\log_2$ higher cleavage efficiency in an in vitro biochemical competitive assay compared to the cleavage by the same protease of a control sequence having the sequence EAGRSANHEPLGLVAT (SEQ ID NO.: 1). In another embodiment, the disclosure provides recombinant polypeptides comprising an RS1 and a FBM, wherein the RS1 is a substrate for cleavage by a protease selected from legumain, MMP-2, MMP-7, MMP-9, MMP-11, MMP-14, uPA, or matriptase and wherein the RS1 has at least a 0.2 $\log_2$, or 0.4 $\log_2$, or 0.8 $\log_2$, or 1.0 $\log_2$ lower cleavage efficiency in an in vitro biochemical competitive assay compared to the cleavage by the same protease of a control sequence having the sequence EAGRSANHEPLGLVAT (SEQ ID NO.: 1).

In another aspect, the disclosure relates to recombinant polypeptides comprising an RS1, a FBM, and at least a first bulking moiety. One advantage of various recombinant polypeptide compositions is that they can be assembled in the form of a prodrug, wherein the intact composition can be activated when in proximity to a target tissue or a certain cellular environment in which mammalian proteases are present that are capable of cleaving the release segment and releasing the FBM at the site where its activity is most desirable. For example, the FBM, when the recombinant polypeptide is in an intact, uncleaved state, has lower binding affinity for its ligand due to the shielding effect of the bulking moiety. Upon its release via cleavage of the release segment by a mammalian protease co-localized in a target tissue, for example, a tumor tissue, the FBM regains its full potential to bind the target cell marker as it is no longer being shielded by the bulking moiety. In some embodiments, the bulking moiety is a first extended recombinant polypeptide (XTEN1). In one embodiment, the XTEN1 comprises an amino acid sequence having at least about 90%, 91%, 92%, 93%, 94%, 95%, 96%, 97%, 98%, 99%, or 100% sequence identity to a sequence selected from the sequences set forth in Table 8 or Table 10. In another embodiment, the XTEN1 comprises an amino acid sequence having at least about 90%, 91%, 92%, 93%, 94%, 95%, 96%, 97%, 98%, 99%, or 100% sequence identity to a sequence selected from AE 144_1A, AE 144_2A, AEE144_2B, AE 144_3A, AE144_3B, AE 144_4A, AE 144_4B, AE 144_5A, AE 144_6B, AE284, AE288_1, AE288_2, AE288_3, AE576, AE864, AE864_2, AE865, AE866, AE867, AE867_2, and AE868. In one embodiment, the recombinant polypeptide comprising an RS1, a FBM, and an XTEN1 has, in an uncleaved state, a structural arrangement from N-terminus to C-terminus of FBM-RS1-XTEN1. In another embodiment, the recombinant polypeptide comprising an RS1, a FBM, and an XTEN1 has, in an uncleaved state, a structural arrangement from N-terminus to C-terminus of XTEN1-RS1-FBM. Thus, in the embodiments of recombinant polypeptides comprising an RS1, a FBM, and an XTEN1, upon cleavage of the RS1 by the mammalian protease, the XTEN1 and the FBM are released from the recombinant polypeptide.

In another aspect, the disclosure relates to recombinant polypeptides comprising an RS1, a FBM, and an XTEN1 wherein the FBM is an antibody fragment. In one embodiment, the FBM is an antibody fragment selected from the group consisting of Fv, Fab, Fab', Fab'-SH, linear antibody, and single-chain variable fragment (scFv). In some embodiments, the FBM antibody fragment has binding affinity for an effector cell antigen expressed on the surface of an effector cell selected from a plasma cell, a T cell, a B cell, a cytokine induced killer cell (CIK cell), a mast cell, a dendritic cell, a regulatory T cell (RegT cell), a helper T cell, a myeloid cell, and a NK cell. In one embodiment, the FBM antibody fragment has binding affinity for an effector cell antigen expressed on the surface of a T cell. In another embodiment, FBM antibody fragment has binding affinity for CD3. In one embodiment of the FBM antibody fragment with binding affinity for CD3, the antibody fragment comprises a VL and VH derived from a monoclonal antibody having binding specificity to CD3. In another embodiment of the FBM antibody fragment with binding affinity for CD3, the antibody fragment comprises a VL and VH selected from the sequences set forth in Table 4. In another embodiment of the FBM antibody fragment with binding affinity for CD3, the antibody fragment comprises complementarity-determining regions (CDR) derived from a monoclonal antibody having binding specificity to CD3. In another embodiment of the FBM antibody fragment with binding affinity for CD3, the antibody fragment comprises a CDR-H1 region, a CDR-H2 region, a CDR-H3 region, a CDR-L1 region, a CDR-L2 region, and a CDR-H3 region, wherein each is derived from a monoclonal antibody of Table 4.

In another aspect, the disclosure relates to recombinant polypeptides comprising an RS1, an XTEN1, a FBM and a second binding moiety (SBM) wherein the SBM is an antibody fragment having binding affinity for a target cell marker. In one embodiment, the FBM and the SBM are each an antibody fragment selected from the group consisting of Fv, Fab, Fab', Fab'-SH, linear antibody, and single-chain variable fragment (scFv) or the VL and VH of the FBM and SBM are configured as a single chain diabody. In some embodiments, the SBM antibody fragment has binding affinity for a target cell marker on a tumor cell or a cancer cell. In one embodiment, the SBM antibody fragment has binding affinity for a target cell marker selected from the target cell markers set forth in Table 5. In another embodiment, the SBM antibody fragment has binding affinity for a target cell marker selected from A33 antigen, alpha-fetoprotein (AFP), alpha 4 integrin, Ang2, B7-H3, B7-H6, B-cell maturation antigen (BCMA), cancer antigen 19-9 (CA19-9), cancer antigen 125 (CA-125), Carbonic Anhydrase 6 (CA6), carbonic anhydrase IX (CAIX), CEACAM5, cMET, CTLA4, C-C Motif Chemokine Receptor 1 (CCR1), C-C Motif Chemokine Receptor 2 (CCR2), C-C Motif Chemokine Receptor 3 (CCR3), C-C Motif Chemokine Receptor 4 (CCR4), C-C Motif Chemokine Receptor 5 (CCR5), C-C Motif Chemokine Receptor 6 (CCR6), C-C Motif Chemokine Receptor 7 (CCR7), C-C Motif Chemokine Receptor 8 (CCR8), C-C Motif Chemokine Receptor 9 (CCR9), Cluster of Differentiation 7 (CD7), CD22, CD70, CD79a, CD79b, CD19, CCR8, CEA, βhCG, Lewis-Y, CA19-9, CA-125, CD20, CD22, CD25, CD33, CD38, CD30, CD44v6, CD47, CD56 (NCAM), CD63, CD79b, CD123, CD133, CD138, CD166, claudin-1, claudin 18.2, C-type lectin-like molecule-1 (CLL-1), C-type lectin domain family 12 (CLEC12), Cora antigen, delta like canonical notch ligand 3 (DDL3), desmoglein 4, delta like non-xanonical notch ligand 1 (DLK1), Ectonucleotide Pyrophosphatase/Phosphodiesterase 3 (ENPP3), EGFR, EGFRvIII, EpCAM, endosialin (CD248), epidermal growth factor receptor variant III (EGFRvIII), EphA2, F19 antigen, fetal acetylcholine receptor (fnAChR), fibroblast activation antigen (FAP), Fos-related antigen 1 (FRA1), Folate Receptor 1 (FOLR1), fucosyl GM1, G250, ganglioside GD3, glypican-3 (GPC3), 9-O-Acetyl-GD3, GM2, Glucocorticoid induced TNF receptor (GITR), globohexaosylceramide (globo-H), GD2, Glypican 3 (GPC3), guanylyl cyclase C (GCC), HER2, HER2 neu, HER3, HER4, HER1, IL13Rα2, insulin-like growth factor I receptor (IGF-IR), Lysosomal Associated Membrane Protein 1 (LAMP1), L1 Cell Adhesion Molecule (LiCAM), lymphocyte antigen 6 (Ly-6), melanoma chondroitin sulfate proteoglycan (MCSP), Membrane-type metalloproteinase (MT-MMP), mesothelin, mucin 1 (MUC1), MUC2, MUC3, MUC4, MUC5AC, MUC5B, MUC7, MUC16, Muellerian inhibitory substance receptor type II (MISIIR), nectin cell adhesion molecule 4 (Nectin-4), 6-transmembrane epithelial antigen of prostate (STEAP), plasma cell antigen 1, prostate stem cell antigen (PSCA), Programmed Cell Death 1 (PD1), Programmed death-ligand 1 (PD-L1), PSMA, Receptor Tyrosine Kinase Like Orphan Receptor 1 (ROR1), sialylated Tn antigen (s TN), sodium-dependent phosphate transport protein 2b (NaPi2b), Sonic Hedgehog (Shh), SAS, SLAM Family Member 7 (SLAM7), Somatostatin Receptor 2 (SSTR2), Sperm Autoantigenic Protein 17 (SP17), TAG72, Thomsen-Friedenreich antigen (TF-antigen), tumor-associated antigen L6 (TAL6), trophoblast glycoprotein (5T4), Trop-2, Wue-1, VEGFR1, VEGFR2, and Wilms tumor protein (WT1). In another embodiment, the SBM antibody fragment comprises a VL and VH derived from a monoclonal antibody having binding affinity to the target cell marker. In another embodiment, the SBM antibody fragment comprises a VL and VH derived from a monoclonal antibody, wherein the VL and VH are selected from the sequences set forth in Table 5. In another embodiment, the SBM antibody fragment comprises a CDR-H1 region, a CDR-H2 region, a CDR-H3 region, a CDR-L1 region, a CDR-L2 region, and a CDR-H3 region, wherein each is derived from a monoclonal antibody set forth in Table 5. In the foregoing embodiments, wherein the recombinant polypeptide comprises the FBM, the SBM, the RS1 and the XTEN1, in an uncleaved state, the recombinant polypeptide has a structural arrangement from N-terminus to C-terminus of SBM-FBM-RS1-XTEN1, FBM-SBM-RS1-XTEN1, XTEN1-RS1-SBM-FBM, XTEN1-RS1-FBM-SBM, or diabody-RS1-XTEN1, or XTEN1-RS1-diabody, wherein the diabody comprises VL and VH of the FBM and SBM. In one embodiment, the disclosure provides a recombinant polypeptide comprising a FBM, SBM, RS1, and an XTEN1, wherein the recombinant polypeptide comprises an amino acid sequence having at least about 90%, 91%, 92%, 93%, 94%, 95%, 96%, 97%, 98%, 99%, or 100% sequence identity to a sequence selected from the group of sequences set forth in Table 14.

In a particular designed feature of the foregoing embodiments, upon cleavage of the RS1 by the mammalian protease and release of the FBM and SBM from the recombinant polypeptide, the FBM and SBM remain fused and are capable of binding to and linking together a T cell bearing the CD3 antigen and a tumor cell bearing the target cell marker in an in vitro assay comprising both the T cells and the tumor cells. Upon the binding and linking of the T cell bearing the CD3 antigen and the tumor cell bearing the target cell marker by the fused FBM and SBM, the binding together of the T cell and the tumor cell results in cytotoxic activity against the tumor cell in the in vitro assay, as determined by quantitation of cell lysis or release of intracellular components. In one embodiment of the recombinant polypeptide, wherein the RS1 is cleaved and the FBM and SBM are released, the released, fused FBM and SBM are capable of effecting a greater amount of cell lysis of the tumor cell compared to the cell lysis effected by the uncleaved recombinant polypeptide in in vitro assays performed under equivalent molar concentrations, as determined by quantitation of cell lysis or release of intracellular components. In one embodiment, the amount of cell lysis effected by the released FBM and SBM of the recombinant polypeptide is at least 10-fold greater, or at least 30-fold, or at least 100-fold, or at least 300-fold, or at least 1000-fold, or at least 10,000-fold greater compared to the cell lysis effected by the uncleaved recombinant polypeptide in the in vitro assays performed under equivalent molar concentrations, as determined by quantitation of cell lysis or release of intracellular components. In the foregoing embodiments, the cytotoxic activity and/or cell lysis of the tumor cell may be mediated by target specific activation of the T cell. In one embodiment, the amount of activation of the T cell effected by the released FBM and SBM is at least 10-fold greater, or at least 30-fold, or at least 100-fold, or at least 300-fold, or at least 1000-fold greater, or at least 10,000-fold greater compared to the activation effected by the uncleaved recombinant polypeptide, as determined by quantitation of T cell-derived effector molecules in in vitro assays performed under equivalent molar concentrations. In a particular feature imparted by the design of the subject recombinant polypeptides, upon cleavage of the RS1 by the mammalian protease and release of the FBM and SBM from the recombinant polypeptide, the FBM and SBM remain fused and exhibit increased binding affinity to the CD3 antigen and/or the target cell marker in an in vitro assay comprising CD3 antigen or target cell marker compared the binding affinity of the intact, uncleaved recombinant polypeptide to the CD3 antigen or to the target cell marker, when assayed under equivalent molar concentrations. In one embodiment, the binding affinity of the released FBM to the CD3 antigen or the released SBM to the target cell marker is at least 10-fold greater, or at least 30-fold, or at least 100-fold, or at least 300-fold, or at least 1000-fold greater, as determined as a $K_d$ constant in the in vitro assay, compared to the binding affinity of the intact, uncleaved recombinant polypeptide to the CD3 antigen or to the target cell marker, when assayed under equivalent molar concentrations. In the foregoing embodiment, the $K_d$ constant of the binding of the released FBM of the recombinant polypeptide to the CD3 antigen is between $10^{-5}$ to $10^{-9}$ M and the $K_d$ of the binding of the released SBM to the target specific marker is between $10^{-5}$ to $10^{-9}$ M. In another embodiment, the binding affinity of the released SBM to the target cell marker is at least one order of magnitude greater compared to the lower binding affinity of the released FBM to the CD3 antigen, as determined as $K_d$ constants in the in vitro assay, when assayed under equivalent molar concentrations. The in vitro assay utilized can be selected from cell membrane integrity assay, mixed cell culture assay, FACS based propidium Iodide assay, trypan Blue influx assay, photometric enzyme release assay, radiometric 51Cr release assay, fluorometric Europium release assay, CalceinAM release assay, photometric MTT assay, XTT assay, WST-1 assay, alamar blue assay, radiometric 3H-Thd incorporation assay, clonogenic assay measuring cell division activity, fluorometric rhodamine123 assay measuring mitochondrial transmembrane gradient, apoptosis assay monitored by FACS-based phosphatidylserine exposure, ELISA-based TUNEL test assay, sandwich ELISA, caspase activity assay, cell-based LDH release assay, and cell morphology assay, or any combination thereof.

In another aspect, the disclosure relates to recombinant polypeptides comprising an RS1, FBM, SBM, XTEN1 having the elements described in the embodiments, above, and further comprising a second release segment (RS2) that is a substrate for cleavage by a mammalian protease, and a second XTEN (XTEN2). The disclosure contemplates different configurations of the recombinant polypeptides, wherein in an uncleaved state, the recombinant polypeptide has a structural arrangement from N-terminus to C-terminus as follows: XTEN1-RS1-SBM-FBM-RS2-XTEN2, XTEN1-RS1-FBM-SBM-RS2-XTEN2, XTEN2-RS2-SBM-FBM-RS1-XTEN1, XTEN2-RS2-FBM-SBM-RS1-XTEN1, XTEN2-RS2-diabody-RS1-XTEN1, wherein the diabody comprises VL and VH of the FBM and SBM, or XTEN1-RS1-diabody-RS2-XTEN2, wherein the diabody comprises VL and VH of the FBM and SBM. In one embodiment, the XTEN2 of the recombinant polypeptide comprises an amino acid sequence having at least about 90%, 91%, 92%, 93%, 94%, 95%, 96%, 97%, 98%, 99%, or 100% sequence identity to a sequence selected from the group of sequences set forth in Table 8 or Table 10. In another embodiment, the XTEN2 of the recombinant polypeptide comprises an amino acid sequence having at least about 90%, 91%, 92%, 93%, 94%, 95%, 96%, 97%, 98%, 99%, or 100% sequence identity to a sequence selected from AE 144_1A, AE 144_2A, AEE144_2B, AE 144_3A, AE144_3B, AE 144_4A, AE 144_4B, AE 144_5A, AE 144_6B, AE284, AE288_1, AE288_2, AE288_3, AE576, AE864, AE864_2, AE865, AE866, AE867, AE867_2, and AE868. In some embodiments of the subject recombinant polypeptides, the RS2 sequence is identical compared to the RS1 sequence. In other embodiments, the RS2 sequence is different compared to the RS1 sequence and each comprise an amino acid sequence having at least 88%, or at least 89%, or at least 90%, or at least 91%, or at least 92%, or at least 93%, or at least 94%, or at least 95% sequence identity to sequences selected from the sequences of Table 1 or Table 2. In another embodiment, the RS2 sequence is different compared to the RS1 sequence and each comprises a sequence selected from the sequences of Table 1 or Table 2. In another embodiment, the disclosure provides a recombinant polypeptide comprising an XTEN1, RS1, SBM, FBM, RS2, and XTEN2, wherein the recombinant polypeptide comprises an amino acid sequence having at least about 90%, 91%, 92%, 93%, 94%, 95%, 96%, 97%, 98%, 99%, or 100% sequence identity to a sequence selected from the group of sequences set forth in Table 15 or Table 18.

In one embodiment, the disclosure provides a recombinant polypeptide comprising an RS1, RS2, FBM, SBM, XTEN1, and XTEN2, wherein i) the RS1 and RS2, wherein the RS1 and RS2 are each a substrate for cleavage by a mammalian protease and each comprise an amino acid sequence having at least 90%, at least 93%, at least 97%, or 100% sequence identity to a sequence selected from the sequences of Table 2; ii) the FBM is an antibody fragment comprising a VL and VH derived from a monoclonal antibody having binding specificity to an effector cell; iii) the SBM is an antibody fragment comprising a VL and VH derived from a monoclonal antibody having binding affinity to a target cell marker; iv) the XTEN1 and XTEN2 each comprise an amino acid sequence having at least about 90%, 91%, 92%, 93%, 94%, 95%, 96%, 97%, 98%, 99%, or 100% sequence identity to a sequence selected from the group of sequences set forth in Table 10; and v) the recombinant polypeptide has a structural arrangement from N-terminus to C-terminus as follows: XTEN1-RS1-SBM-FBM-RS2-XTEN2, XTEN1-RS1-FBM-SBM-RS2-XTEN2, XTEN2-RS2-SBM-FBM-RS1-XTEN1, XTEN2-RS2-FBM-SBM-RS1-XTEN1, XTEN2-RS2-diabody-RS1-XTEN1, wherein the diabody comprises VL and VH of the FBM and SBM. In the foregoing embodiment, the effector cell is a T cell and the target cell marker is selected from A33 antigen, alpha-fetoprotein (AFP), alpha 4 integrin, Ang2, B7-H3, B7-H6, B-cell maturation antigen (BCMA), cancer antigen 19-9 (CA19-9), cancer antigen 125 (CA-125), Carbonic Anhydrase 6 (CA6), carbonic anhydrase IX (CAIX), CEACAM5, cMET, CTLA4, C-C Motif Chemokine Receptor 1 (CCR1), C-C Motif Chemokine Receptor 2 (CCR2), C-C Motif Chemokine Receptor 3 (CCR3), C-C Motif Chemokine Receptor 4 (CCR4), C-C Motif Chemokine Receptor 5 (CCR5), C-C Motif Chemokine Receptor 6 (CCR6), C-C Motif Chemokine Receptor 7 (CCR7), C-C Motif Chemokine Receptor 8 (CCR8), C-C Motif Chemokine Receptor 9 (CCR9), Cluster of Differentiation 7 (CD7), CD22, CD70, CD79a, CD79b, CD19, CCR8, CEA, βhCG, Lewis-Y, CA19-9, CA-125, CD20, CD22, CD25, CD33, CD38, CD30, CD44v6, CD47, CD56 (NCAM), CD63, CD79b, CD123, CD133, CD138, CD166, claudin-1, claudin 18.2, C-type lectin-like molecule-1 (CLL-1), C-type lectin domain family 12 (CLEC12), Cora antigen, delta like canonical notch ligand 3 (DDL3), desmoglein 4, delta like non-xanonical notch ligand 1 (DLK1), Ectonucleotide Pyrophosphatase/Phosphodiesterase 3 (ENPP3), EGFR, EGFRvIII, EpCAM, endosialin (CD248), epidermal growth factor receptor variant III (EGFRvIII), EphA2, F19 antigen, fetal acetylcholine receptor (fnAChR), fibroblast activation antigen (FAP), Fos-related antigen 1 (FRA1), Folate Receptor 1 (FOLR1), fucosyl GM1, G250, ganglioside GD3, glypican-3 (GPC3), 9-O-Acetyl-GD3, GM2, Glucocorticoid induced TNF receptor (GITR), globohexaosylceramide (globo-H), GD2, Glypican 3 (GPC3), guanylyl cyclase C (GCC), HER2, HER2 neu, HER3, HER4, HER1, IL13Rα2, insulin-like growth factor I receptor (IGF-IR), Lysosomal Associated Membrane Protein 1 (LAMP1), L1 Cell Adhesion Molecule (L1CAM), lymphocyte antigen 6 (Ly-6), melanoma chondroitin sulfate proteoglycan (MCSP), Membrane-type metalloproteinase (MT-MMP), mesothelin, mucin 1 (MUC1), MUC2, MUC3, MUC4, MUC5AC, MUC5B, MUC7, MUC16, Muellerian inhibitory substance receptor type II (MISIIR), nectin cell adhesion molecule 4 (Nectin-4), 6-transmembrane epithelial antigen of prostate (STEAP), plasma cell antigen 1, prostate stem cell antigen (PSCA), Programmed Cell Death 1 (PD1), Programmed death-ligand 1 (PD-L1), PSMA, Receptor Tyrosine Kinase Like Orphan Receptor 1 (ROR1), sialylated Tn antigen (s TN), sodium-dependent phosphate transport protein 2b (NaPi2b), Sonic Hedgehog (Shh), SAS, SLAM Family Member 7 (SLAM7), Somatostatin Receptor 2 (SSTR2), Sperm Autoantigenic Protein 17 (SP17), TAG72, Thomsen-Friedenreich antigen (TF-antigen), tumor-associated antigen L6 (TAL6), trophoblast glycoprotein (5T4), Trop-2, Wue-1, VEGFR1, VEGFR2, and Wilms tumor protein (WT1). The RS1 and the RS2 sequences can be identical or they can be different sequences selected from Table 2. In one embodiment, the RS2 sequence is different compared to the RS1 sequence and each is a substrate for a different protease set forth in Table 3. In another embodiment, the RS1 and the RS2 sequences are identical each is a substrate for two or more proteases selected from legumain, MMP-2, MMP-7, MMP-9, MMP-11, MMP-14, uPA, and matriptase. In a particular designed feature of the foregoing embodiments, upon cleavage of the RS1 and the RS2 by the mammalian protease(s) and release of the FBM and SBM from the recombinant polypeptide, the FBM and SBM remain fused and are capable of binding to and linking together a T cell bearing the CD3 antigen and a tumor cell bearing the target cell marker in an in vitro assay comprising both the T cells and the tumor cells. In another designed feature of the foregoing embodiments, the lower ability of the recombinant polypeptide in an uncleaved state to induce lysis of the tumor cell bearing the target cell marker antigen in an in vitro assay comprising both T cells and tumor cells is at least two orders of magnitude less, or at least three orders of magnitude less, or at least four orders of magnitude less compared to the greater amount of lysis induced by the FBM or the SBM that have been released from the recombinant polypeptide by cleavage of the RS1 and RS2, as determined by quantitation of cell lysis or release of intracellular components when assayed under equivalent molar concentrations. In another particular designed feature of the foregoing embodiments of the recombinant polypeptide comprising an RS1, RS2, FBM, SBM, XTEN1, and XTEN2, the binding affinity of the uncleaved recombinant polypeptide to the CD3 antigen or to the target cell marker in an in vitro assay comprising CD3 antigen or target cell marker is at least one order of magnitude less, as determined as a $K_d$ constant, compared to binding affinity to the CD3 antigen or to the target cell marker of an uncleaved recombinant polypeptide comprising an RS1, RS2, FBM, SBM, XTEN1 but not comprising a second release segment and a second XTEN, when assayed under equivalent molar concentrations. In one embodiment, the binding affinity of the uncleaved recombinant polypeptide comprising an RS1, RS2, FBM, SBM, XTEN1, and XTEN2 to the CD3 antigen or to the target cell marker in an in vitro assay comprising CD3 antigen or target cell marker is at least two orders of magnitude less, or at least three orders of magnitude less, or at least four orders of magnitude less, as determined as a $K_d$ constant in the in vitro assay, compared to the binding affinity to CD3 antigen or target cell marker of the FBM or the SBM that have been released from the recombinant polypeptide by cleavage of the RS1 and the RS2, when assayed under equivalent molar concentrations. The in vitro assay utilized can be selected from cell membrane integrity assay, mixed cell culture assay, FACS based propidium Iodide assay, trypan Blue influx assay, photometric enzyme release assay, radiometric 51Cr release assay, fluorometric Europium release assay, CalceinAM release assay, photometric MTT assay, XTT assay, WST-1 assay, alamar blue assay, radiometric 3H-Thd incorporation assay, clonogenic assay measuring cell division activity, fluorometric rhodamine123 assay measuring mitochondrial transmembrane gradient, apoptosis assay monitored by FACS-based phosphatidylserine exposure, ELISA-based TUNEL test assay, sandwich ELISA, caspase activity assay, cell-based LDH release assay, and cell morphology assay, or any combination thereof.

The recombinant polypeptide compositions provided herein can be useful for a variety of purposes including therapeutics and diagnostics. In one aspect, the disclosure relates to recombinant polypeptide compositions administered to a subject. As will be appreciated by those of ordinary skill in the art, administration of a recombinant polypeptide having the elements described in the embodiments, above, to a subject having a target cell, such as a tumor, the release segment(s) of the recombinant polypeptide are capable of being cleaved when in proximity to the tumor, wherein the tumor or surrounding tissue is expressing one or more proteases for which the release segment(s) are a substrate. In one embodiment, upon cleavage of the release segment(s) by the protease and release of the FBM and SBM from the administered recombinant polypeptide in the subject, the fused FBM and SBM are capable of binding to and linking together a T cell bearing the CD3 antigen and a tumor cell bearing a tumor specific marker that is a ligand for the SBM in the subject. Upon the binding together of the T cell bearing the CD3 antigen and the tumor cell bearing the tumor cell marker by the released FBM and SBM, forming an immunological synapse, the binding results in the release of one or more T cell-derived effector molecules by the T cell. In one embodiment, the one or more effector molecules are selected from TNF-alpha, IFN-gamma, interleukin 2, perforin, and granzymes. Upon the binding together of the T cell bearing the CD3 antigen and the tumor cell bearing the tumor specific marker, lysis of the tumor cell in the subject is effected by the T cell-derived effector molecules. In the foregoing embodiments, the subject is selected from the group consisting of mouse, rat, monkey, dog, and human.

In another aspect, the disclosure relates to the pharmacokinetic properties of the subject recombinant polypeptides and the released components after administrations to a subject. In one embodiment, the uncleaved recombinant polypeptide exhibits a terminal half-life following administration of a single dose to a subject that is at least five-fold, 10-fold, 20-fold, 30-fold, 40-fold, 50-fold, or 100-fold greater compared to the terminal half-life of the fused FBM and SBM not linked to the recombinant polypeptide when the uncleaved recombinant polypeptide and the fused FBM and SBM are each administered to a subject at a equivalent molar dose. In another embodiment, following the administration of a therapeutically effective single dose of the recombinant polypeptide to a subject having one or more tumor-associated proteases capable of cleaving the release segment(s) of the recombinant polypeptide, the fused FBM and SBM cleaved and released from the recombinant polypeptide exhibit a terminal half-life that is at least five-fold, 10-fold, or 20-fold, or 30-fold, or 50-fold, or 100-fold less compared to the terminal half-life of the corresponding recombinant polypeptide that is not cleaved in the subject. In another embodiment, following the administration of a therapeutically effective single dose of the recombinant polypeptide to a subject having a tumor-associated protease capable of cleaving the release segment(s) of the recombinant polypeptide, the plasma Cmax concentration of the released fused FBM and SBM does not exceed about 0.01 ng/ml, or about 0.1 ng/ml, or about 1 ng/ml, or about 10 ng/ml, or about 100 ng/ml. In another embodiment, following the administration of a therapeutically effective single dose of the recombinant polypeptide to a subject having a tumor-associated protease capable of cleaving the release segment(s) of the recombinant polypeptide, the plasma area under the curve of the released FBM and SBM is at least 10-fold lower, or at least 30-fold lower, or at least 100-fold lower compared to the plasma area under the curve of the uncleaved recombinant polypeptide in the subject. In the foregoing embodiments, the subject is selected from the group consisting of mouse, rat, monkey, dog, and human.

The present disclosure provides pharmaceutical compositions comprising any of the recombinant polypeptides described herein, together with one or more pharmaceutically suitable excipients. In one embodiment, the pharmaceutical composition is formulated for intradermal, subcutaneous, intravenous, intra-arterial, intraabdominal, intraperitoneal, intrathecal, or intramuscular administration. In another embodiment, the pharmaceutical composition is in a liquid form. In another embodiment, the pharmaceutical composition is in a pre-filled syringe for a single injection. In another embodiment, the pharmaceutical composition is formulated as a lyophilized powder to be reconstituted prior to administration.

The present disclosure contemplates use of the recombinant polypeptide of any one of embodiments described herein in the preparation of a medicament for the treatment of a disease in a subject. In one embodiment, the disease to be treated by the medicament is selected from the group consisting of carcinoma, Hodgkin's lymphoma, and non-Hodgkin's lymphoma, diffuse large B cell lymphoma, follicular lymphoma, mantle cell lymphoma, blastoma, breast cancer, ER/PR+ breast cancer, Her2+ breast cancer, triple-negative breast cancer, colon cancer, colon cancer with malignant ascites, mucinous tumors, prostate cancer, head and neck cancer, skin cancer, melanoma, genito-urinary tract cancer, ovarian cancer, ovarian cancer with malignant ascites, peritoneal carcinomatosis, uterine serous carcinoma, endometrial cancer, cervix cancer, colorectal, uterine cancer, mesothelioma in the peritoneum, kidney cancer, Wilm's tumor, lung cancer, small-cell lung cancer, non-small cell lung cancer, gastric cancer, stomach cancer, small intestine cancer, liver cancer, hepatocarcinoma, hepatoblastoma, liposarcoma, pancreatic cancer, gall bladder cancer, cancers of the bile duct, esophageal cancer, salivary gland carcinoma, thyroid cancer, epithelial cancer, arrhenoblastoma, adenocarcinoma, sarcoma, and B-cell derived chronic lymphatic leukemia.

In another aspect, the disclosure relates to methods of treating a disease in a subject. In one embodiment, the disclosure provides a method of treating a disease in a subject, comprising administering to the subject in need thereof one or more therapeutically effective doses of the recombinant polypeptide or a pharmaceutical composition comprising the recombinant polypeptide any one of the embodiments described herein. In one embodiment, the disease to be treated by the method is selected from the group consisting of carcinomas, Hodgkin's lymphoma, non-Hodgkin's lymphoma, B cell lymphoma, T-cell lymphoma, follicular lymphoma, mantle cell lymphoma, blastoma, breast cancer, colon cancer, prostate cancer, head and neck cancer, any form of skin cancer, melanoma, genito-urinary tract cancer, ovarian cancer, ovarian cancer with malignant ascites, peritoneal carcinomatosis, uterine serous carcinoma, endometrial cancer, cervical cancer, colorectal cancer, an epithelia intraperitoneal malignancy with malignant ascites, uterine cancer, mesothelioma in the peritoneum kidney cancers, lung cancer, small-cell lung cancer, non-small cell lung cancer, gastric cancer, esophageal cancer, stomach cancer, small intestine cancer, liver cancer, hepatocarcinoma, hepatoblastoma, liposarcoma, pancreatic cancer, gall bladder cancer, cancers of the bile duct, salivary gland carcinoma, thyroid cancer, epithelial cancer, adenocarcinoma, sarcomas of any origin, primary hematologic malignancies including acute or chronic lymphocytic leukemias, acute or chronic myelogenous leukemias, myeloproliferative neoplastic disorders, or myelodysplastic disorders, myasthenia gravis, Morbus Basedow, Hashimoto thyroiditis, or Goodpasture syndrome. In another embodiment, the disclosure provides a method of treatment wherein the pharmaceutical composition or recombinant polypeptide is administered to the subject as one or more therapeutically effective doses administered twice weekly, once a week, every two weeks, every three weeks, or monthly. In another embodiment of the method of treatment, the pharmaceutical composition or recombinant polypeptide is administered to the subject as one or more therapeutically effective doses over a period of at least two weeks, or at least one month, or at least two months, or at least three months, or at least four months, or at least five months, or at least six months. In the method of treatment, the dose can be administered intradermally, subcutaneously, intravenously, intra-arterially, intra-abdominally, intraperitoneally, intrathecally, or intramuscularly. In another embodiment of the method of treatment, the pharmaceutical composition or recombinant polypeptide dose is administered as a bolus dose or by infusion of 5 minutes to 96 hours as tolerated for maximal safety and efficacy. In the foregoing embodiments of the method of treatment, the dose to be administered is selected from the group consisting of at least about 0.005 mg/kg, at least about 0.01 mg/kg, at least about 0.02 mg/kg, at least about 0.04 mg/kg, at least about 0.08 mg/kg, at least about 0.1 mg/kg, at least about 0.12 mg/kg, at least about 0.14 mg/kg, at least about 0.16 mg/kg, at least about 0.18 mg/kg, at least about 0.20 mg/kg, at least about 0.22 mg/kg, at least about 0.24 mg/kg, at least about 0.26 mg/kg, at least about 0.27 mg/kg, at least about 0.28 mg/kg, at least about 0.3 mg/kg, at least 0.4 mg/kg, at least about 0.5 mg/kg, at least about 0.6 mg/kg, at least about 0.7 mg/kg, at least about 0.8 mg/kg, at least about 0.9 mg/kg, at least about 1.0 mg/kg, at least about 1.5 mg/kg, or at least about 2.0 mg/kg. In another embodiment of the method of treatment, an initial dose is selected from the group consisting of at least about 0.005 mg/kg, at least about 0.01 mg/kg, at least about 0.02 mg/kg, at least about 0.04 mg/kg, at least about 0.08 mg/kg, at least about 0.1 mg/kg, and a subsequent dose is selected from the group consisting of at least about 0.1 mg/kg, at least about 0.12 mg/kg, at least about 0.14 mg/kg, at least about 0.16 mg/kg, at least about 0.18 mg/kg, at least about 0.20 mg/kg, at least about 0.22 mg/kg, at least about 0.24 mg/kg, at least about 0.26 mg/kg, at least about 0.27 mg/kg, at least about 0.28 mg/kg, at least 0.3 mg/kg, at least 0.4. mg/kg, at least about 0.5 mg/kg, at least about 0.6 mg/kg, at least about 0.7 mg/kg, at least about 0.8 mg/kg, at least about 0.9 mg/kg, at least about 1.0 mg/kg, at least about 1.5 mg/kg, or at least about 2.0 mg/kg. In another embodiment of the method of treatment, the administration to the subject results in a plasma concentration of the recombinant polypeptide of at least about 0.1 ng/mL to at least about 2 ng/mL or more in the subject for at least about 3 days, at least about 7 days, at least about 10 days, at least about 14 days, or at least about 21 days. In the foregoing embodiments of the method of treatment, the subject is selected from the group consisting of mouse, rat, monkey, and human.

In another aspect, the disclosure relates to treatment regimens. In one embodiment, the treatment regimen uses a recombinant polypeptide or pharmaceutical composition described herein for use in a method for the treatment of a disease, the method comprising administering the pharmaceutical composition or the recombinant polypeptide to a subject with the disease, optionally according to a treatment regimen comprising two or more consecutive doses using a therapeutically effective dose. The disease to be treated by the regimen is selected from the group consisting of carcinomas, Hodgkin's lymphoma, non-Hodgkin's lymphoma, B cell lymphoma, T-cell lymphoma, follicular lymphoma, mantle cell lymphoma, blastoma, breast cancer, colon cancer, prostate cancer, head and neck cancer, any form of skin cancer, melanoma, genito-urinary tract cancer, ovarian cancer, ovarian cancer with malignant ascites, peritoneal carcinomatosis, uterine serous carcinoma, endometrial cancer, cervical cancer, colorectal cancer, an epithelia intraperitoneal malignancy with malignant ascites, uterine cancer, mesothelioma in the peritoneum kidney cancers, lung cancer, small-cell lung cancer, non-small cell lung cancer, gastric cancer, esophageal cancer, stomach cancer, small intestine cancer, liver cancer, hepatocarcinoma, hepatoblastoma, liposarcoma, pancreatic cancer, gall bladder cancer, cancers of the bile duct, salivary gland carcinoma, thyroid cancer, epithelial cancer, adenocarcinoma, sarcomas of any origin, primary hematologic malignancies including acute or chronic lymphocytic leukemias, acute or chronic myelogenous leukemias, myeloproliferative neoplastic disorders, or myelodysplastic disorders, myasthenia gravis, Morbus Basedow, Hashimoto thyroiditis, and Goodpasture syndrome. In another embodiment, the pharmaceutical composition or the recombinant polypeptide for the use in the treatment regimen is part of a specified treatment cycle. The treatment cycle can comprise administration of the pharmaceutical composition or the recombinant polypeptide twice a week, every week, every 10 days, every two weeks, every three weeks, or every month per each treatment cycle. In the foregoing regimen embodiments, the treatment regimen results in the improvement of a clinical parameter or endpoint associated with the disease in the subject. The clinical parameter or endpoint associated with the disease in the subject can be one or any combination of the group consisting of tumor shrinkage as a complete, partial or incomplete response; time-to-progression, time to treatment failure, biomarker response; progression-free survival; disease free-survival; time to recurrence; time to metastasis; time of overall survival; improvement of quality of life; and improvement of symptoms.

In another aspect, the disclosure provides kits. In one embodiment, the disclosure provides a kit comprising the pharmaceutical composition of any one of the embodiments described herein, together with a container and a label or package insert on or associated with the container.

In yet another embodiment, the disclosure provides one or more isolated nucleic acids, the nucleic acid comprising (a) a polynucleotide encoding a recombinant polypeptide of any one of the embodiments described herein; or (b) the complement of the polynucleotide of (a). The disclosure also provides an expression vector comprising the polynucleotide sequences encoding the recombinant polypeptide of any one of the embodiments described herein and a recombinant regulatory sequence operably linked to the polynucleotide sequence. The disclosure also provides an isolated host cell, comprising the foregoing expression vector. In one embodiment the host cell is a prokaryote. In another embodiment, the host cell is E. coli.

In another aspect, the disclosure relates to methods of manufacturing an activatable recombinant polypeptide. In one embodiment, the disclosure provides a method of manufacturing an activatable recombinant polypeptide composition, the method comprising: a) culturing a host cell comprising a nucleic acid construct that encodes the activatable recombinant polypeptide under conditions that lead to expression of the activatable recombinant polypeptide, wherein the activatable recombinant polypeptide comprises an RS1, RS2, FBM, SBM, XTEN1, and XTEN2, wherein: i) the RS1 and RS2, wherein the RS1 and RS2 are each substrates for cleavage by a mammalian protease and each comprise an amino acid sequence having at least 88%, or at least 89%, or at least 90%, or at least 91%, or at least 92%, or at least 93%, or at least 94%, or at least 95%, or 100% sequence identity to a sequence selected from the sequences of Table 1 or Table 2; ii) the FBM is an antibody fragment comprising a VL and VH derived from a monoclonal antibody having binding specificity to CD3; iii) the SBM is an antibody fragment comprising a VL and VH derived from a monoclonal antibody having binding affinity to the target cell marker selected from A33 antigen, alpha-fetoprotein (AFP), alpha 4 integrin, Ang2, B7-H3, B7-H6, B-cell maturation antigen (BCMA), cancer antigen 19-9 (CA19-9), cancer antigen 125 (CA-125), Carbonic Anhydrase 6 (CA6), carbonic anhydrase IX (CAIX), CEACAM5, cMET, CTLA4, C-C Motif Chemokine Receptor 1 (CCR1), C-C Motif Chemokine Receptor 2 (CCR2), C-C Motif Chemokine Receptor 3 (CCR3), C-C Motif Chemokine Receptor 4 (CCR4), C-C Motif Chemokine Receptor 5 (CCR5), C-C Motif Chemokine Receptor 6 (CCR6), C-C Motif Chemokine Receptor 7 (CCR7), C-C Motif Chemokine Receptor 8 (CCR8), C-C Motif Chemokine Receptor 9 (CCR9), Cluster of Differentiation 7 (CD7), CD22, CD70, CD79a, CD79b, CD19, CCR8, CEA, βhCG, Lewis-Y, CA19-9, CA-125, CD20, CD22, CD25, CD33, CD38, CD30, CD44v6, CD47, CD56 (NCAM), CD63, CD79b, CD123, CD133, CD138, CD166, claudin-1, claudin 18.2, C-type lectin-like molecule-1 (CLL-1), C-type lectin domain family 12 (CLEC12), Cora antigen, delta like canonical notch ligand 3 (DDL3), desmoglein 4, delta like non-xanonical notch ligand 1 (DLK1), Ectonucleotide Pyrophosphatase/Phosphodiesterase 3 (ENPP3), EGFR, EGFRvIII, EpCAM, endosialin (CD248), epidermal growth factor receptor variant III (EGFRvIII), EphA2, F19 antigen, fetal acetylcholine receptor (fnAChR), fibroblast activation antigen (FAP), Fos-related antigen 1 (FRA1), Folate Receptor 1 (FOLR1), fucosyl GM1, G250, ganglioside GD3, glypican-3 (GPC3), 9-O-Acetyl-GD3, GM2, Glucocorticoid induced TNF receptor (GITR), globohexaosylceramide (globo-H), GD2, Glypican 3 (GPC3), guanylyl cyclase C (GCC), HER2, HER2 neu, HER3, HER4, HER1, IL13Rα2, insulin-like growth factor I receptor (IGF-IR), Lysosomal Associated Membrane Protein 1 (LAMP1), L1 Cell Adhesion Molecule (L1CAM), lymphocyte antigen 6 (Ly-6), melanoma chondroitin sulfate proteoglycan (MCSP), Membrane-type metalloproteinase (MT-MMP), mesothelin, mucin 1 (MUC1), MUC2, MUC3, MUC4, MUC5AC, MUC5B, MUC7, MUC16, Muellerian inhibitory substance receptor type II (MISIIR), nectin cell adhesion molecule 4 (Nectin-4), 6-transmembrane epithelial antigen of prostate (STEAP), plasma cell antigen 1, prostate stem cell antigen (PSCA), Programmed Cell Death 1 (PD1), Programmed death-ligand 1 (PD-L1), PSMA, Receptor Tyrosine Kinase Like Orphan Receptor 1 (ROR1), sialylated Tn antigen (s TN), sodium-dependent phosphate transport protein 2b (NaPi2b), Sonic Hedgehog (Shh), SAS, SLAM Family Member 7 (SLAM7), Somatostatin Receptor 2 (SSTR2), Sperm Autoantigenic Protein 17 (SP17), TAG72, Thomsen-Friedenreich antigen (TF-antigen), tumor-associated antigen L6 (TAL6), trophoblast glycoprotein (5T4), Trop-2, Wue-1, VEGFR1, VEGFR2, and Wilms tumor protein (WT1); iv) the XTEN1 and XTEN2 each comprise an amino acid sequence having at least about 90%, 91%, 92%, 93%, 94%, 95%, 96%, 97%, 98%, 99%, or 100% sequence identity to a sequence selected from the group of sequences set forth in Table 8 or Table 10; iv) the recombinant polypeptide has a structural arrangement from N-terminus to C-terminus as follows: XTEN1-RS1-SBM-FBM-RS2-XTEN2, XTEN1-RS1-FBM-SBM-RS2-XTEN2, XTEN2-RS2-SBM-FBM-RS1-XTEN1, XTEN2-RS2-FBM-SBM-RS1-XTEN1, XTEN2-RS2-diabody-RS1-XTEN1, wherein the diabody comprises VL and VH of the FBM and SBM; and b) recovering the activatable polypeptide composition. In the foregoing method, the activatable recombinant polypeptide is activated by cleavage of the RS1 and RS2 by one or more proteases capable of cleaving the RS1 and RS2, resulting in the release of the FBM and SBM from the composition, wherein the FBM and SBM remain fused. In one embodiment of the method, the XTEN1 and XTEN2 of the activatable recombinant polypeptide in an uncleaved state interfere with specific binding of the FBM to the CD3 and the SBM to the target cell marker such that the dissociation constant ($K_d$) of the FBM of the activatable recombinant polypeptide in an uncleaved state towards CD3 or the SBM to the target cell marker is at least 100 times greater compared to the FBM or the SBM released from the activatable recombinant polypeptide by cleavage of the RST and RS2, when measured in in vitro assays comprising the target cell marker under equivalent molar concentrations.

BRIEF DESCRIPTION OF THE DRAWINGS

The features and advantages of the invention may be further explained by reference to the following detailed description and accompanying drawings that sets forth illustrative embodiments FIG. 1 depicts the various schematic figures used in various drawings, together with descriptions of what they represent.

FIG. 3 shows the uncleaved "pro" form of ProTIA in FIG. 3A and the cleaved form in FIG. 3B in which the uncleaved form is depicted in proximity to an effector cell and a tumor associated cell, each with cell-surface antigens; however the uncleaved form in FIG. 3A is unable to concurrently bind the two cells because of the steric hindrance and shielding effects of the XTEN on the binding moieties, while the cleaved form in FIG. 3B, with the released binding moieties, permits the concurrent binding of the two cells and allows and immune activation by the effector cell against the target tumor associated cell.

FIG. 5 shows schematic representations of two configurations of the ProTIA compositions in which two Release Segments and two XTEN are linked to the binding moieties. In the case of FIG. 5A, one RS and XTEN is linked to the effector cell binding moiety and the other RS and XTEN is linked to the tumor antigen binding moiety, and the composition would be in a scFv configuration. In the case of FIG. 5B, both RS and XTEN are attached to either the effector cell binding moiety (on the left) or the tumor antigen binding moiety (on the right), and the binding moieties would be in a diabody configuration (thus permitting the composition to be produced in recombinant form).

FIG. 6 shows schematic representations of two configurations of the ProTIA compositions in which the XTEN is an XTEN polypeptide, and the RS and XTEN is linked either to the effector cell binding moiety (on the left) or the RS and XTEN is linked to the tumor antigen binding moiety (on the right). FIGS. 6A-D show alternative N- and C-terminal configurations for the binding moieties.

FIG. 7 shows schematic representations of two configurations of the ProTIA compositions in which two Release Segments and two XTEN are linked to the binding moieties. In the case of FIG. 7A, one RS and one XTEN is linked to the effector cell binding moiety and the other RS and XTEN is linked to the tumor antigen binding moiety, and the composition would be in a scFv configuration. In the case of FIG. 7B, both RS and XTEN are attached to either the effector cell binding moiety (on the right) or the tumor antigen binding moiety (on the left), and the binding moieties would be in a diabody configuration (thus permitting the composition to be produced in recombinant form).

FIG. 8 shows schematic representations of two configurations of the ProTIA compositions in which the RS and XTEN is linked either to the effector cell binding moiety (on the left) or the tumor antigen binding moiety (on the right). FIG. 8A depicts the binding moieties as XTEN. FIG. 8B depicts the binding moieties as albumin. FIG. 8C depicts the binding moieties as an Fc fragment.

FIG. 9 shows schematic representations of configurations of the ProTIA compositions in which two Release Segments and two XTEN are linked to the binding moieties. FIG. 9A depicts three configurations in which the two RS and XTEN are linked to both the effector cell binding moiety and the tumor antigen binding moiety (on the left), to the tumor antigen binding moiety (the center) or to the effector cell binding moiety (on the right). FIG. 9B depicts four configurations in which the one RS and XTEN are linked to the effector cell binding moiety and one RS and albumin are linked to the tumor antigen binding moiety (on the upper left), one RS and an XTEN are linked to the tumor antigen binding moiety and one RS and albumin are linked to the effector cell binding moiety (on the upper right), both the RS and an XTEN and the RS and albumin are linked to the tumor antigen binding moiety (on the lower left) and both the RS and an XTEN and the RS and albumin are linked to the effector cell binding moiety (on the lower right). FIG. 9C depicts four configurations in which the one RS and XTEN are linked to the effector cell binding moiety and one RS and Fc are linked to the tumor antigen binding moiety (on the upper left), one RS and an XTEN are linked to the tumor antigen binding moiety and one RS and Fc are linked to the effector cell binding moiety (on the upper right), both the RS and an XTEN and the RS and Fc are linked to the tumor antigen binding moiety (on the lower left) and both the RS and an XTEN and the RS and Fc are linked to the effector cell binding moiety (on the lower right).

FIG. 11 shows a schematic representation of an scFv configuration of the effector cell binding moiety the tumor antigen binding moiety, each with VH/VL pairs joined by linkers, and in a tandem format.

FIG. 12 shows a schematic representation of a single chain diabody configuration of the effector cell binding moiety the tumor antigen binding moiety, each with VH/VL pairs joined by linkers.

FIG. 13 shows schematic representations of constructs. FIG. 13A shows a schematic representation of a generic construct design. FIGS. 13B and 13C show schematic representations of ProTIA compositions in which the effector cell binding moiety and the tumor antigen binding moiety are in various permutations in scFv configurations (FIG. 13B) [with variable heavy (VH) and variable light (VL) domains linked either by intramolecular long linker (L) or intermolecular shorter linker (l)] and in single chain diabody configurations (FIG. 13C) [with the VH and VL domains linked either by long linker (L) or intermolecular shorter linker (l).

FIG. 14 shows the purification of uncleaved AC1278 from fermentation media, as described in Example 2. FIG. 14A shows exemplary SDS-PAGE of IMAC capture of AC1278 from fermentation media; FIG. 14B shows SDS-PAGE analysis of fractions in HIC polishing step; FIG. 14C shows SDS-PAGE analysis of fractions in ImpRes-Q polishing step.

FIG. 15 shows the lot release analytics of uncleaved AC1278, as described in Example 2. FIG. 15A shows the lot release analytical SEC chromatography of uncleaved AC1278 (in solid line) against XTEN length standard (in dashed line); FIG. 15B shows the lot release SDS-PAGE of uncleaved AC1278.

FIG. 16 shows the preparation of cleaved ProTIA-A using uncleaved AC1278, as described in Example 2. FIG. 16A shows SDS-PAGE analysis of MMP-9 digestion reaction mixture; FIG. 16B show SDS-PAGE analysis of IMAC purification of MMP-9 digestion mixture to remove cleaved XTEN segment.

FIG. 17 shows the lot release analytics of cleaved AC1278, as described in Example 2. FIG. 17A shows the lot release analytical SEC chromatography of cleaved AC1278

(in solid line) against globular protein standard (in dashed line); FIG. 17B shows the lot release SDS-PAGE of cleaved AC1278.

FIG. 18 shows the purification of uncleaved AC1476 from fermentation media, as described in Example 3. FIG. 18A shows exemplary SDS-PAGE of IMAC capture of AC1476 from fermentation media; FIG. 18B shows SDS-PAGE analysis of fractions in HIC polishing step; FIG. 18C shows SDS-PAGE analysis of fractions in ImpRes-Q polishing step.

FIG. 19 shows the lot release analytics of uncleaved AC1476 as described in Example 3. FIG. 19A shows the lot release analytical SEC chromatography of uncleaved AC1476 (in solid line) against XTEN length standard (in dashed line); FIG. 19B shows the lot release SDS-PAGE of uncleaved AC1476 with Coomassie staining; FIG. 19C shows the lot release SDS-PAGE of uncleaved AC1476 with silver staining.

FIG. 20 shows additional lot release analytics of uncleaved AC1476 as described in Example 3. FIG. 20A shows the lot release ESI-MS of uncleaved AC1476; FIG. 20B shows the lot release cation exchange chromatography of uncleaved AC1476.

FIG. 21 shows the preparation of cleaved ProTIA-A using uncleaved AC1476 as described in Example 3. FIG. 21A shows the SDS-PAGE analysis of MMP-9 digestion reaction mixture; FIG. 21B shows the SDS-PAGE analysis of anion exchange fractions of MMP-9 digestion mixture to remove uncleaved substrate, as well as cleaved XTEN segment.

FIG. 22 shows the lot release analytics of cleaved AC1476 as described in Example 3. FIG. 22A shows the lot release analytical SEC of cleaved AC1476 (in solid line) against globular protein standard (in dashed line); FIG. 22B shows the lot release SDS-PAGE of cleaved AC1476 with Coomassie staining; FIG. 22C shows the lot release SDS-PAGE of cleaved AC1476 with silver staining.

FIG. 23 shows the additional lot release analytics of cleaved AC1476 as described in Example 3. FIG. 23A shows the lot release ESI-MS of cleaved AC1476; FIG. 23B shows the lot release cation exchange chromatography of cleaved AC1476.

FIG. 29 shows schematic representations of the alternate N- to C-terminus configurations of a T-cell binding composition. FIG. 29A shows the configuration of the effector cell binding moiety (ECBM) followed by release site segment (RS) and XTEN while FIG. 29B shows the configuration of XTEN followed by the RS segment and then ECBM.

FIG. 33 depicts results from an experiment to determine the cytokine profile of protease-treated and untreated anti-EpCAM×anti-CD3 ProTIA, as described in Example 12. FIG. 33A shows the results of the assay to detect IL-2 and FIG. 33B shows the results to detect IL-4.

FIG. 34 depicts results from an experiment to determine the cytokine profile of protease-treated and untreated anti-EpCAM×anti-CD3 ProTIA, as described in Example 12. FIG. 34A shows the results of the assay to detect IL-6 and FIG. 34B shows the results to detect IL-10.

FIG. 35 depicts results from an experiment to determine the cytokine profile of protease-treated and untreated anti-EpCAM×anti-CD3 ProTIA, as described in Example 12. FIG. 35A shows the results of the assay to detect IFN-gamma and FIG. 35B shows the results to detect TNF-alpha.

FIG. 42 depicts results from the experiment to measure activation of CD69 on CD8 and CD4 cells in co-culture of PBMC and SK-OV-3 cells with protease-treated, protease-untreated and protease noncleavable anti-EpCAM×anti-CD3 ProTIA, as described in Example 8. FIG. 42A depicts the activation of CD69 on CD8 cells, while FIG. 42B depicts the activation of CD69 on CD4 cells.

FIG. 43 depicts results from the experiment to measure activation of both CD69 and CD25 on CD8 and CD4 cells in co-culture of PBMC and SK-OV-3 cells with protease-treated, protease-untreated and protease noncleavable anti-EpCAM×anti-CD3 ProTIA, as described in Example 8. FIG. 43A depicts the activation of both CD69 and CD25 on CD8 cells, while FIG. 43B depicts the activation of both CD69 and CD25 on CD4 cells.

FIG. 44 depicts results from the experiment to measure activation of CD69 on CD8 and CD4 cells in co-culture of purified CD3+ cells and SK-OV-3 cells with protease-treated, protease-untreated and protease noncleavable anti-EpCAM×anti-CD3 ProTIA, as described in Example 8. FIG. 44A depicts the activation of CD69 on CD8 cells, while FIG. 44B depicts the activation of CD69 on CD4 cells.

FIG. 45 depicts results from the experiment to measure activation of both CD69 and CD25 on CD8 and CD4 cells in co-culture of purified CD3+ cells and SK-OV-3 cells with protease-treated, protease-untreated and protease noncleavable anti-EpCAM×anti-CD3 ProTIA, as described in Example 8. FIG. 45A depicts the activation of both CD69 and CD25 on CD8 cells, while FIG. 45B depicts the activation of both CD69 and CD25 on CD4 cells.

FIG. 46 depicts results from the experiment to measure activation of CD69 on CD8 and CD4 cells in co-culture of purified CD3+ cells and OVCAR3 cells with protease-treated, protease-untreated and protease noncleavable anti-EpCAM×anti-CD3 ProTIA, as described in Example 8. FIG. 46A depicts the activation of CD69 on CD8 cells, while FIG. 46B depicts the activation of CD69 on CD4 cells.

FIG. 47 depicts results from the experiment to measure activation of both CD69 and CD25 on CD8 and CD4 cells in co-culture of purified CD3+ cells and OVCAR3 cells with protease-treated, protease-untreated and protease noncleavable anti-EpCAM×anti-CD3 ProTIA, as described in Example 8. FIG. 47A depicts the activation of both CD69 and CD25 on CD8 cells, while FIG. 47B depicts the activation of both CD69 and CD25 on CD4 cells.

FIG. 48 depicts results from the experiment to measure activation of CD69 on CD8 and CD4 cells in co-culture of PBMC and OVCAR3 cells with protease-treated, protease-untreated and protease noncleavable anti-EpCAM×anti-CD3 ProTIA, as described in Example 8. FIG. 48A depicts the activation of CD69 on CD8 cells, while FIG. 48B depicts the activation of CD69 on CD4 cells.

FIG. 49 depicts results from the experiment to measure activation of both CD69 and granzyme B in CD8 and CD4 cells in co-culture of PBMC and OVCAR3 cells with protease-treated, protease-untreated and protease noncleavable anti-EpCAM×anti-CD3 ProTIA, as described in Example 8. FIG. 49A depicts the activation of both CD69 and granzyme B in CD8 cells, while FIG. 49B depicts the activation of both CD69 and granzyme B in CD4 cells.

FIG. 50 depicts results from the experiment to measure release of cytokines IL-2 and IL-4 in co-culture of purified CD3+ cells and SK-OV-3 cells with protease-treated, protease-untreated and protease noncleavable anti-EpCAM×anti-CD3 ProTIA, as described in Example 15. FIG. 50A depicts the concentration of released IL-2, while FIG. 50B depicts the concentration of released IL-4.

FIG. 51 depicts results from the experiment to measure release of cytokines IL-6 and IL-10 in co-culture of purified CD3+ cells and SK-OV-3 cells with protease-treated, protease-untreated and protease noncleavable anti-EpCAM×anti-CD3 ProTIA, as described in Example 15. FIG. 51A depicts the concentration of released IL-6, while FIG. 51B depicts the concentration of released IL-10.

FIG. 52 depicts results from the experiment to measure release of cytokines TNF-alpha and IFN-gamma in co-culture of purified CD3+ cells and SK-OV-3 cells with protease-treated, protease-untreated and protease noncleavable anti-EpCAM×anti-CD3 ProTIA, as described in Example 15. FIG. 52A depicts the concentration of released TNF-alpha, while FIG. 52B depicts the concentration of released IFN-gamma.

FIG. 69 depicts (FIG. 69A) plasma and (FIG. 69B) ascites pharmacokinetics results of intravenously administered protease-treated, protease-untreated, and non-cleavable anti-EpCAM×anti-CD3 ProTIAs, as described in Example 30.

FIG. 70 depicts (FIG. 70A) plasma and (FIG. 70B) ascites pharmacokinetics results of intraperitoneally administered protease-treated, protease-untreated, and non-cleavable anti-EpCAM×anti-CD3 ProTIAs, as described in Example 30.

FIGS. 71A-F shows the results from cytokine assays of samples from an in vivo toxicity assessment of the intact, cleaved and uncleavable ProTIA constructs compared to a construct configured as a BiTE, as described Example 33.

FIGS. 73A-F shows the results from an experiment to determine the maximum tolerated dose of an intact AC1553 ProTIA compared to the cleaved, activated form, graphed as body weight of the dosed mice over time, as described in Example 34.

FIG. 74A is a titer analysis of RS-XTEN variant expression. FIGS. 74(B)-(D) show the single-step IMAC purification of RS-XTEN variants AC1602, AC1609, AC1610, AC1604, AC1608, AC1611, AC1612, AC1649, AC1650.

FIG. 79 shows results of tumor volume in vehicle and treatment groups, as described in Example 60. FIG. 79A shows results of animals dosed with 0.5 mg/kg and FIG. 79B shows results of animals dosed with 0.1 mg/kg.

FIG. 80 shows results of redirected cellular cytotoxicity assays of protease-untreated anti-EGFR×anti-CD3 ProTIA compositions compared to protease-treated anti-EGFR×anti-CD3 ProTIA and protease-non-cleavable as described in Example 61. FIG. 80A shows results of the in vitro caspase 3/7 assay of AC1955 and AC1958 against HCT-116 cells with human PBMC. FIG. 80B shows results of the in vitro caspase 3/7 assay of AC1955 and AC1958 against HT-29 cells with human PBMC.

FIG. 81 shows results from redirected cellular cytotoxicity assays of protease-untreated anti-Her2×anti-CD3 ProTIA compositions AC2038 and AC2040 compared to protease-treated anti-Her2×anti-CD3 ProTIA and protease-non-cleavable AC2039), assessed in an in vitro cell-based assay of caspase 3/7 activities of apoptotic cells as described in Example 62. FIG. 81A shows results with BT474 with human PBMC. FIG. 81B shows results with SK-OV-3 and human PBMC. FIG. 81C shows results with JIMT-1 with human PBMC. FIG. 81D shows results with MDA-MB-231 with human PBMC.

FIG. 82 shows results from in vivo experiments to determine to determine the anti-tumor effect of protease-treated and protease-untreated anti-EGFR×anti-CD3 ProTIA against Cetuximab as described in Example 63. FIG. 82A depicts tumor volume results from animals with HT-29 tumor cells. FIG. 82B depicts body weight results from animals with HT-29 tumor cells.

FIG. 83 shows results from in vivo experiments to determine the anti-tumor effect of protease-treated and protease-untreated anti-EGFR×anti-CD3 ProTIA in an established breast tumor model, as described in Example 64. FIG. 83A depicts tumor volume results from animals with BT-474 tumor cells. FIG. 83B depicts body weight results from animals with BT-474 tumor cells.

FIG. 85 shows lot release HPLC analyses of formulated drug substance, as described in Example 46. FIG. 85A shows the SE-HPLC analysis and FIG. 85B shows the HI-HPLC analysis.

FIG. 86 shows lot release analyses of formulated drug substance, as described in Example 47. FIG. 86A shows an SDS-PAGE of the lot release analysis of formulated drug substance. FIG. 86B shows an ESI-MS of the lot release analysis of formulated drug substance.

FIG. 87 shows lot release HPLC analyses of formulated drug substance, as described in Example 46. FIG. 87A shows the SE-HPLC analysis and FIG. 87B shows the HI-HPLC analysis.

DETAILED DESCRIPTION OF THE INVENTION

Figure 2:
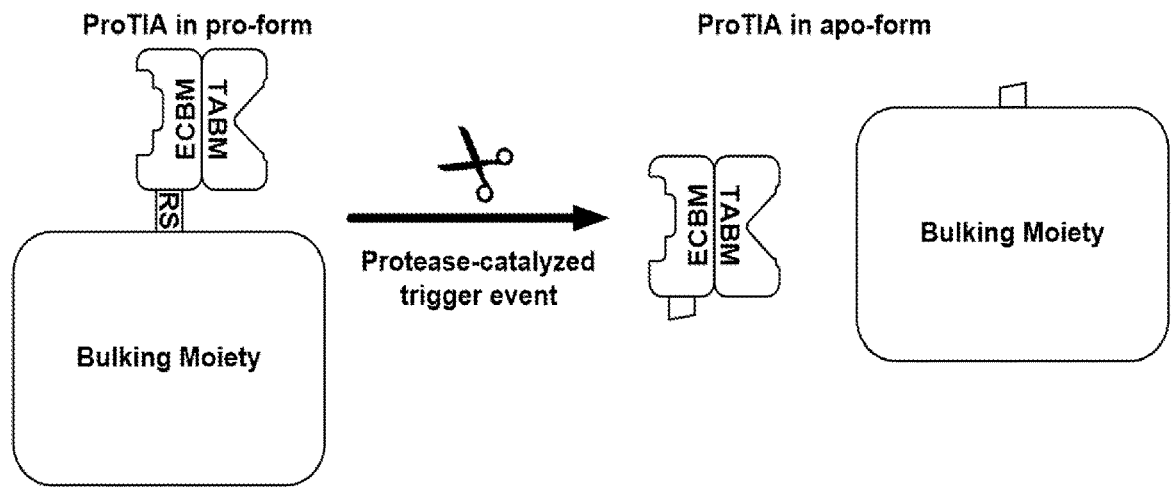
FIG. 2 depicts a ProTIA composition (a form of recombinant polypeptide composition described herein) that is in the uncleaved, "pro" form and in the cleaved state after being acted on by a tumor associated protease. The figure also describes some of the non-limiting properties of both forms of the compositions.
Figure 4:
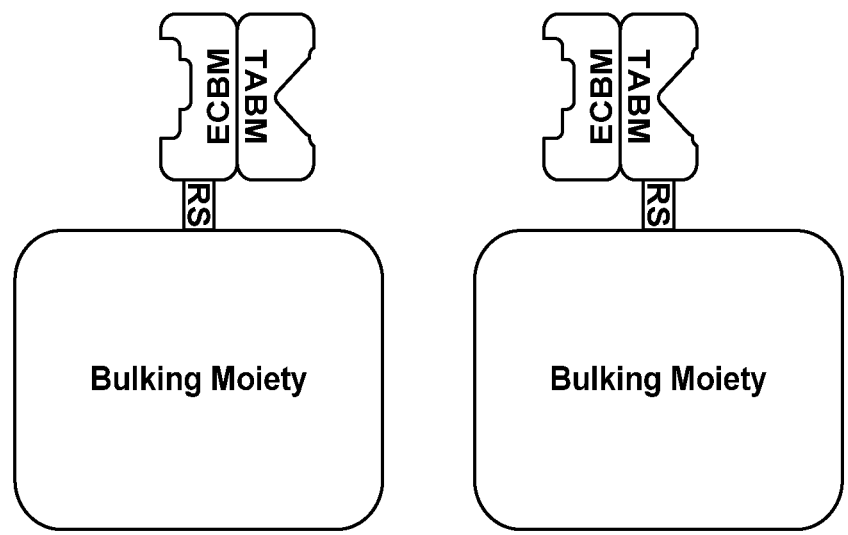
FIG. 4 shows schematic representations of two configurations of the ProTIA compositions, illustrating that the Release Segment and the XTEN can be attached to either the effector cell binding moiety or the tumor antigen binding moiety.
Figure 10:
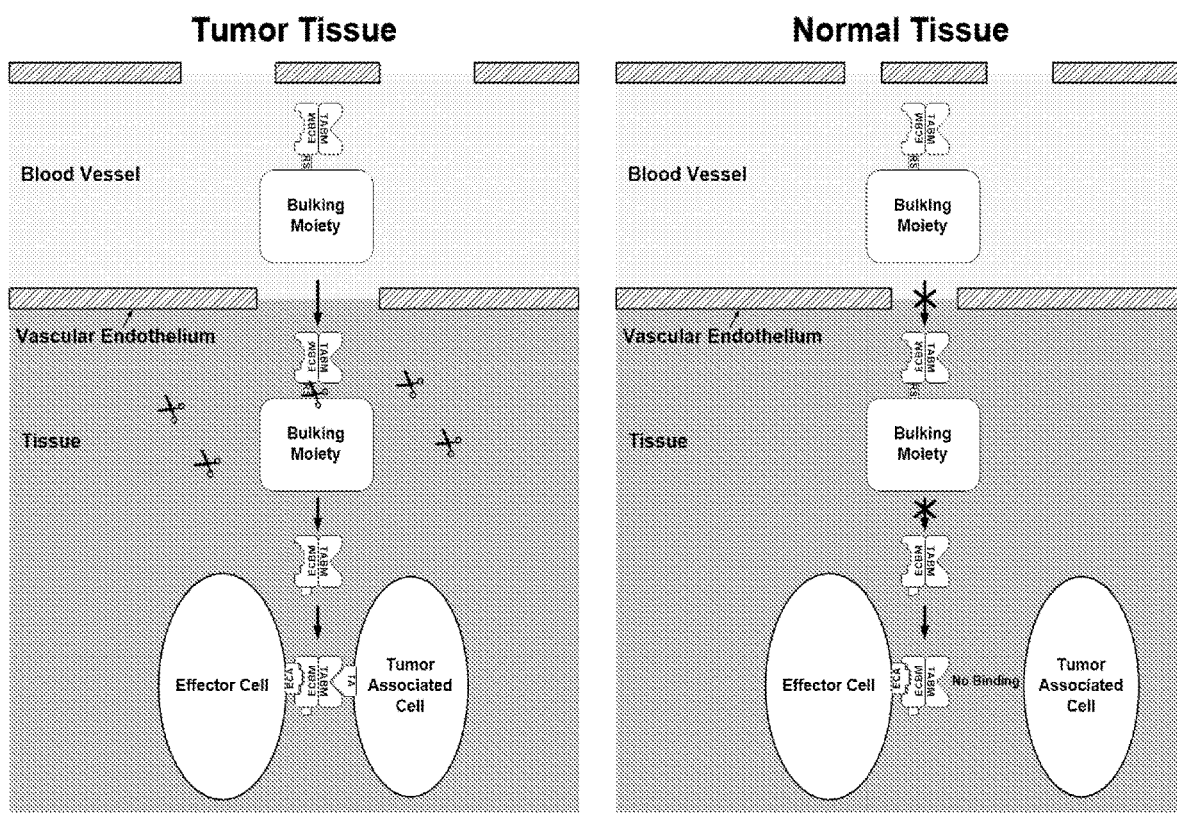
FIG. 10 shows schematic representations of a ProTIA in proximity to tumor tissue (on the left) and normal tissue (on the right) in which the more permeable vasculature in the tumor tissue permits the ProTIA to extravasate into the tissue where the tumor-associated proteases can act on the RS, cleaving it and releasing the binding moieties, which in turn can bind to and link together the effector cell and the tumor associated cell. In the case of the normal tissue, the extravasation is either blocked by the tighter vasculature barriers or, in the case where the ProTIA does extravasate, the ProTIA remains in the "pro" form and while able to bind the effector cell, no tumor cells are present or, if present, insufficient proteases are present to release the binding moieties, with the net effect that an immunological synapse is not formed.

Before the embodiments of the disclosure are described, it is to be understood that such embodiments are provided by way of example only, and that various alternatives to the embodiments of the disclosure described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

Definitions

In the context of the present application, the following terms have the meanings ascribed to them unless specified otherwise:

As used throughout the specification and claims, the terms "a", "an" and "the" are used in the sense that they mean "at least one", "at least a first", "one or more" or "a plurality" of the referenced components or steps, except in instances wherein an upper limit is thereafter specifically stated. Therefore, a "cleavage sequence", as used herein, means "at least a first cleavage sequence" but includes a plurality of cleavage sequences. The operable limits and parameters of combinations, as with the amounts of any single agent, will be known to those of ordinary skill in the art in light of the present disclosure.

The terms "polypeptide", "peptide", and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

As used herein in the context of the structure of a polypeptide, "N-terminus" (or "amino terminus") and "C-terminus" (or "carboxyl terminus") refer to the extreme amino and carboxyl ends of the polypeptide, respectively.

The term "monomeric" as applied to a polypeptide refers to the state of the polypeptide as being a single continuous amino acid sequence substantially unassociated with one or more additional polypeptide of the same or different sequence. The monomeric state of the polypeptide can be ascertained as a single proteinaceous entity of the same molecular weight by size exclusion chromatography.

As used herein, the term "amino acid" refers to either natural and/or unnatural or synthetic amino acids, including but not limited to both the D or L optical isomers, and amino acid analogs and peptidomimetics. Standard single or three letter codes may be used to designate amino acids.

The term "natural L-amino acid" or "L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in a mammal. For example, a non-naturally occurring polypeptide or fragment may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water. Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine. Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" when applied to a biologically active protein (and not an antibody), is a truncated form of a the biologically active protein that retains at least a portion of the therapeutic and/or biological activity. A "variant," when applied to a biologically active protein is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity compared with the reference biologically active protein. As used herein, the term "biologically active protein variant" includes proteins modified deliberately, as for example, by site directed mutagenesis, synthesis of the encoding gene, insertions, or accidentally through mutations and that retain activity.

The term "sequence variant" means polypeptides that have been modified compared to their native or original sequence by one or more amino acid insertions, deletions, or substitutions. Insertions may be located at either or both termini of the protein, and/or may be positioned within internal regions of the amino acid sequence. A non-limiting example is substitution of an amino acid in an XTEN with a different amino acid. In deletion variants, one or more amino acid residues in a polypeptide as described herein are removed. Deletion variants, therefore, include all fragments of a described polypeptide sequence. In substitution variants, one or more amino acid residues of a polypeptide are removed and replaced with alternative residues. In one aspect, the substitutions are conservative in nature and conservative substitutions of this type are well known in the art. In the context of an antibody or a biologically active polypeptide, a sequence variant would retain at least a portion of the binding affinity or biological activity, respectively, of the unmodified polypeptide.

The term "moiety" means a component of a larger composition or that is intended to be incorporated into a larger composition, such as a proteinaceous portion joined to a larger polypeptide as a contiguous or non-contiguous sequence. A moiety of a larger composition can confer a desired functionality. For example, an antibody fragment may retain the ability to bind its ligand yet have a smaller molecular size and be in a single-chain format. XTEN may confer the functionality of increasing molecular weight and/or half-life of a resulting larger composition with which the XTEN is associated.

The term "release segment" or "RS" refers to a peptide with one or more cleavage sites in the sequence that can be recognized and cleaved by one or more proteases. As used herein, "mammalian protease" means a protease that normally exists in the body fluids, cells, tissues, and may be found in higher levels in certain target tissues or cells, e.g., in diseased tissues (e.g., tumor) of a mammal. RS sequences can be engineered to be cleaved by various mammalian proteases or multiple mammalian proteases that are present in or proximal to target tissues in a subject or are introduced in an in vitro assay. Other equivalent proteases (endogenous or exogenous) that are capable of recognizing a defined cleavage site can be utilized. It is specifically contemplated that the RS sequence can be adjusted and tailored to the protease utilized and can incorporate linker amino acids to join to adjacent polypeptides of the composition; e.g., the binding moieties and the XTEN.

The term "within", when referring to a first polypeptide being linked to a second polypeptide, encompasses linking or fusion of an additional component that connects the N-terminus of the first or second polypeptide to the C-terminus of the second or first polypeptide, respectively, as well as insertion of the first polypeptide into the sequence of the second polypeptide. For example, when an RS component is linked "within" an recombinant polypeptide, the RS may be linked to the N-terminus, the C-terminus, or may be inserted between any two amino acids of an XTEN polypeptide.

"Activity" as applied to form(s) of a composition provided herein, refers to an action or effect, including but not limited to receptor binding, antagonist activity, agonist activity, a cellular or physiologic response, cell lysis, cell death, or an effect generally known in the art for the effector component of the composition, whether measured by an in vitro, ex vivo or in vivo assay or a clinical effect.

"Effector cell", as used herein, includes any eukaryotic cells capable of conferring an effect on a target cell. For example, an effect cell can induce loss of membrane integrity, pyknosis, karyorrhexis, apoptosis, lysis, and/or death of a target cell. In another example, an effector cell can induce division, growth, differentiation of a target cell or otherwise altering signal transduction of a target cell. Non-limiting examples of effector cell include plasma cell, T cell, CD4 cell, CD8 cell, B cell, cytokine induced killer cell (CIK cell), master cell, dendritic cell, regulatory T cell (RegT cell), helper T cell, myeloid cell, macrophage, and NK cell.

An "effector cell antigen" refers to molecules expressed by an effector cell, including without limitation cell surface molecules such as proteins, glycoproteins or lipoproteins. Exemplary effector cell antigens include proteins of the CD3 complex or the T cell receptor (TCR), CD4, CD8, CD25, CD38, CD69, CD45RO, CD57, CD95, CD107, and CD154, as well as effector molecules such as cytokines in association with, bound to, expressed within, or expressed and released by, an effector cell. An effector cell antigen can serve as the binding counterpart of a binding moiety of the subject recombinant polypeptide. Non-limiting examples of effector cell antigens to which the subject composition may bind include antigens on the cell surface such as CD3, CD4, CD8, CD25, CD38, CD69, CD45RO, CD57, CD95, CD107, and CD154 as well as Th1 cytokines selected from IL2, IL10, IL12, IFN-gamma, and TNF-alpha.

As used herein, the term "ELISA" refers to an enzyme-linked immunosorbent assay as described herein or as otherwise known in the art.

A "host cell" includes an individual cell or cell culture which can be or has been a recipient for the subject vectors into which exogenous nucleic acid has been introduced, such as those described herein. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this disclosure.

"Isolated", when used to describe the various polypeptides disclosed herein, means polypeptide that has been identified and separated and/or recovered from a component of its natural environment or from a more complex mixture (such as during protein purification). Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated nucleic acid" is a nucleic acid molecule that is identified and separated from at least one contaminant nucleic acid molecule with which it is ordinarily associated in the natural source of the polypeptide-encoding nucleic acid. For example, an isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extra-chromosomal location different from that of natural cells.

A "chimeric" protein or polypeptide contains at least one fusion polypeptide comprising at least one region in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by recombinantly creating and translating a polynucleotide in which the peptide regions are encoded in the desired relationship.

"Fused," and "fusion" are used interchangeably herein, and refers to the joining together of two or more peptide or polypeptide sequences by recombinant means. A "fusion protein" or "chimeric protein" comprises a first amino acid sequence linked to a second amino acid sequence with which it is not naturally linked in nature.

"Uncleaved" and "uncleaved state" are used interchangeably herein, and refers to a polypeptide that has not been cleaved or digested by a protease such that the polypeptide remains intact.

"XTENylated" is used to denote a peptide or polypeptide that has been modified by the linking or fusion of one or more XTEN polypeptides (described, below) to the peptide or polypeptide, whether by recombinant or chemical cross-linking means.

"Operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. For example, a promoter or enhancer is operably linked to a coding sequence for a polypeptide if it affects the transcription of the polypeptide sequence. Thus, the resulting recombinant fusion protein is a single protein containing two or more segments that correspond to polypeptides encoded by the original ORFs (which segments are not normally so joined in nature).

"Crosslinking," and "conjugating," are used interchangeably herein, and refer to the covalent joining of two different molecules by a chemical reaction. The crosslinking can occur in one or more chemical reactions, as known in the art.

In the context of polypeptides, a "linear sequence" or a "sequence" is an order of amino acids in a polypeptide in an amino to carboxyl terminus (N- to C-terminus) direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to nucleotides of any length, encompassing a singular nucleic acid as well as plural nucleic acids, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of recombination steps which may include cloning, restriction and/or ligation steps, and other procedures that result in expression of a recombinant protein in a host cell.

The terms "gene" and "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

As used herein, a "coding region" or "coding sequence" is a portion of polynucleotide which consists of codons translatable into amino acids. Although a "stop codon" (TAG, TGA, or TAA) is typically not translated into an amino acid, it may be considered to be part of a coding region, but any flanking sequences, for example promoters, ribosome binding sites, transcriptional terminators, introns, and the like, are not part of a coding region. The boundaries of a coding region are typically determined by a start codon at the 5' terminus, encoding the amino terminus of the resultant polypeptide, and a translation stop codon at the 3' terminus, encoding the carboxyl terminus of the resulting polypeptide. Two or more coding regions of the present disclosure can be present in a single polynucleotide construct, e.g., on a single vector, or in separate polynucleotide constructs, e.g., on separate (different) vectors. It follows, then, that a single vector can contain just a single coding region, or comprise two or more coding regions, e.g., a single vector can separately encode a binding moiety-A and a binding moiety-B as described below. In addition, a vector, polynucleotide, or nucleic acid of the disclosure can encode heterologous coding regions, either fused or unfused to a nucleic acid encoding a binding moiety of the disclosure. Heterologous coding regions include without limitation specialized elements or motifs, such as a secretory signal peptide or a heterologous functional domain.

The term "downstream" refers to a nucleotide sequence that is located 3' to a reference nucleotide sequence. In certain embodiments, downstream nucleotide sequences relate to sequences that follow the starting point of transcription. For example, the translation initiation codon of a gene is located downstream of the start site of transcription.

The term "upstream" refers to a nucleotide sequence that is located 5' to a reference nucleotide sequence. In certain embodiments, upstream nucleotide sequences relate to sequences that are located on the 5' side of a coding region or starting point of transcription. For example, most promoters are located upstream of the start site of transcription.

"Homology" or "homologous" or "Identity" interchangably refers to sequence similarity between two or more polynucleotide sequences or between two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, preferably at least 80%, more preferably at least 90%, more preferably 95%, more preferably 97%, more preferably 98%, and even more preferably 99% sequence identity, when optimally aligned, compared to those sequences. Polypeptides that are homologous preferably have sequence identities that are at least 70%, preferably at least 80%, even more preferably at least 90%, even more preferably at least 95-99% identical when optimally aligned over sequences of comparable length.

"Ligation" as applied to polynucleic acids refers to the process of forming phosphodiester bonds between two nucleic acid fragments or genes, linking them together. To ligate the DNA fragments or genes together, the ends of the DNA must be compatible with each other. In some cases, the ends will be directly compatible after endonuclease digestion. However, it may be necessary to first convert the staggered ends commonly produced after endonuclease digestion to blunt ends to make them compatible for ligation.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60° C. to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al., "Molecular Cloning: A Laboratory Manual," $3^{rd}$ edition, Cold Spring Harbor Laboratory Press, 2001. Typically, blocking reagents are used to block non-specific hybridization. Such blocking reagents include, for instance, sheared and denatured salmon sperm DNA at about 100-200 μg/ml. Organic solvent, such as formamide at a concentration of about 35-50% v/v, may also be used under particular circumstances, such as for RNA:DNA hybridizations. Useful variations on these wash conditions will be readily apparent to those of ordinary skill in the art.

The terms "percent identity," percentage of sequence identity," and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured. The percentage of sequence identity is calculated by comparing two optimally aligned sequences over the window of comparison, determining the number of matched positions (at which identical residues occur in both polypeptide sequences), dividing the number of matched positions by the total number of positions in the window of comparison (i.e., the window size), and multiplying the result by 100 to yield the percentage of sequence identity. When sequences of different length are to be compared, the shortest sequence defines the length of the window of comparison. Conservative substitutions are not considered when calculating sequence identity.

"Percent (%) sequence identity" and "percent (%) identity" with respect to the polypeptide sequences identified herein, is defined as the percentage of amino acid residues in a query sequence that are identical with the amino acid residues of a second, reference polypeptide sequence of comparable length or a portion thereof, after aligning the sequences and introducing gaps, if necessary, to achieve the maximum percent sequence identity, and not considering any conservative substitutions as part of the sequence identity, thereby resulting in optimal alignment. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve optimal alignment over the full length of the sequences being compared. Percent identity may be measured over the length of an entire defined polypeptide sequence, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

"Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

The term "expression" as used herein refers to a process by which a polynucleotide produces a gene product, for example, an RNA or a polypeptide. It includes without limitation transcription of the polynucleotide into messenger RNA (mRNA), transfer RNA (tRNA), small hairpin RNA (shRNA), small interfering RNA (siRNA) or any other RNA product, and the translation of an mRNA into a polypeptide. Expression produces a "gene product." As used herein, a gene product can be either a nucleic acid, e.g., a messenger RNA produced by transcription of a gene, or a polypeptide which is translated from a transcript. Gene products described herein further include nucleic acids with post transcriptional modifications, e.g., polyadenylation or splicing, or polypeptides with post translational modifications, e.g., methylation, glycosylation, the addition of lipids, association with other protein subunits, or proteolytic cleavage.

A "vector" or "expression vector" are used interchangeably and refers to a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, dog, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The terms "$t_{1/2}$", "half-life", "terminal half-life", "elimination half-life" and "circulating half-life" are used interchangeably herein and, as used herein means the terminal half-life calculated as ln(2)/Kei. Kei is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. When a clearance curve of a given polypeptide is constructed as a function of time, the curve is usually biphasic with a rapid α-phase and longer beta-phase. The typical beta-phase half-life of a human antibody in humans is 21 days. Half-life can be measured using timed samples from any body fluid, but is most typically measured in plasma samples.

The term "molecular weight" generally refers to the sum of atomic weights of the constituent atoms in a molecule. Molecular weight can be determined theoretically by summing the atomic masses of the constituent atoms in a molecule. When applied in the context of a polypeptide, the molecular weight is calculated by adding, based on amino acid composition, the molecular weight of each type of amino acid in the composition or by estimation from comparison to molecular weight standards in an SDS electrophoresis gel. The calculated molecular weight of a molecule can differ from the apparent molecular weight of a molecule, which generally refers to the molecular weight of a molecule as determined by one or more analytical techniques. "Apparent molecular weight factor" and "apparent molecular weight" are related terms and when used in the context of a polypeptide, the terms refer to a measure of the relative increase or decrease in apparent molecular weight exhibited by a particular amino acid or polypeptide sequence. The apparent molecular weight can be determined, for example, using size exclusion chromatography (SEC) or similar methods by comparing to globular protein standards, as measured in "apparent kD" units. The apparent molecular weight factor is the ratio between the apparent molecular weight and the "molecular weight"; the latter is calculated by adding, based on amino acid composition as described above, or by estimation from comparison to molecular weight standards in an SDS electrophoresis gel. The determination of apparent molecular weight and apparent molecular weight factor is described in U.S. Pat. No. 8,673,860.

The terms "hydrodynamic radius" or "Stokes radius" is the effective radius (Rh in nm) of a molecule in a solution measured by assuming that it is a body moving through the solution and resisted by the solution's viscosity. In the embodiments of the disclosure, the hydrodynamic radius measurements of the XTEN polypeptides correlate with the "apparent molecular weight factor" which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294,513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Diffusion coefficient" means the magnitude of the molar flux through a surface per unit concentration gradient out-of-plane. In dilute species transport, the flux due to diffusion is given by Fick's first law, which only depends on a single property of the solute's interaction with the solvent: the diffusion coefficient.

"Physiological conditions" refers to a set of conditions in a living host as well as in vitro conditions, including temperature, salt concentration, pH, that mimic those conditions of a living subject. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers are listed in Sambrook et al. (2001). Physiologically relevant temperature ranges from about 25° C. to about 38° C., and preferably from about 35° C. to about 37° C.

The term "binding moiety" is used herein in the broadest sense, and is specifically intended to include the categories of cytokines, cell receptors, antibodies or antibody fragments that have specific affinity for an antigen or ligand such as cell-surface receptors, target cell markers, or antigens or glycoproteins, oligonucleotides, enzymatic substrates, antigenic determinants, or binding sites that may be present in or on the surface of a tissue or cell.

The term "antibody" is used herein in the broadest sense and encompasses various antibody structures, including but not limited to monoclonal antibodies, polyclonal antibodies, multispecific antibodies (e.g., bispecific antibodies), and antibody fragments so long as they exhibit the desired antigen-binding activity. The full-length antibodies may be for example monoclonal, recombinant, chimeric, deimmunized, humanized and human antibodies.

The term "monoclonal antibody" as used herein refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including but not limited to the hybridoma method, recombinant DNA methods, phage-display methods, and methods utilizing transgenic animals containing all or part of the human immunoglobulin loci, such methods and other exemplary methods for making monoclonal antibodies being known in the art or described herein.

An "antibody fragment" refers to a molecule other than an intact antibody that comprises a portion of an intact antibody and that binds the antigen to which the intact antibody binds. Examples of antibody fragments include but are not limited to Fv, Fab, Fab', Fab'-SH, F(ab')2, diabodies, single chain diabodies, linear antibodies, a single domain antibody, a single domain camelid antibody, single-chain variable fragment (scFv) antibody molecules, and multispecific antibodies formed from antibody fragments.

"scFv" or "single chain fragment variable" are used interchangeably herein to refer to an antibody fragment format comprising regions of variable heavy ("VH") and variable light ("VL") chains or two copies of a VH or VL chain, which are joined together by a short flexible peptide linker. The scFv is not actually a fragment of an antibody, but is a fusion protein of the variable regions of the heavy (VH) and light chains (VL) of immunoglobulins, and can be easily expressed in functional form in E. coli in either N- to C-termnus orientation; VL-VH or VH-VL.

The terms "antigen", "target cell marker" and "ligand" are used interchangeably herein to refer to the structure or binding determinant that a binding moiety, an antibody, antibody fragment or an antibody fragment-based molecule binds to or has binding specificity against.

The term "epitope" refers to the particular site on an antigen molecule to which an antibody, antibody fragment, or binding moiety binds. An epitope is a ligand of an antibody, antibody fragment, or a binding moiety.

As used herein, "CD3" or "cluster of differentiation 3" means the T cell surface antigen CD3 complex, which includes in individual form or independently combined form all known CD3 subunits, for example CD3 epsilon, CD3 delta, CD3 gamma, CD3 zeta, CD3 alpha and CD3 beta. The extracellular domains of CD3 epsilon, gamma and delta contain an immunoglobulin-like domain, so are therefore considered part of the immunoglobulin superfamily.

The terms "specific binding" or "specifically bind" or "binding specificity" are used interchangeably herein to refer to the high degree of binding affinity of a binding moiety to its corresponding target. Typically, specific binding as measured by one or more of the assays disclosed herein would have a dissociation constant or $K_a$ of less than about $10^{-6}$ M; e.g, $10^{-7}$ M-$10^{-12}$ M.

"Affinity" refers to the strength of the sum total of noncovalent interactions between a single binding site of a molecule (e.g., an antibody) and its binding partner (e.g., an antigen). Unless indicated otherwise, as used herein, "binding affinity" refers to intrinsic binding affinity which reflects a 1:1 interaction between members of a binding pair (e.g., antibody and antigen). The affinity of a molecule X for its partner Y can generally be represented by the dissociation constant ($K_d$). As used herein "a greater binding affinity" or "increased binding affinity" means a lower $K_d$ value; e.g., $1\times10^{-9}$ M is a greater binding affinity than $1\times10^{-8}$ M, while a "lower binding affinity" means a greater $K_d$ value; e.g., $1\times10^{-7}$ M is a lower binding affinity than $1\times10^{-8}$ M.

"Inhibition constant", or "$K_i$", are used interchangeably and mean the dissociation constant of the enzyme-inhibitor complex, or the reciprocal of the binding affinity of the inhibitor to the enzyme.

"Dissociation constant", or "$K_d$", are used interchangeably and mean the affinity between a ligand "L" and a protein "P"; i.e. how tightly a ligand binds to a particular protein. It can be calculated using the formula $K_d=[L][P]/[LP]$, where [P], [L] and [LP] represent molar concentrations of the protein, ligand and complex, respectively. The term "$k_{on}$", as used herein, is intended to refer to the on rate constant for association of an antibody to the antigen to form the antibody/antigen complex as is known in the art. The term "$k_{off}$", as used herein, is intended to refer to the off rate constant for dissociation of an antibody from the antibody/antigen complex as is known in the art. Techniques such as flow cytometry or surface plasmon resonance can be used to detect binding events. The assays may comprise soluble antigens or receptor molecules, or may determine the binding to cell-expressed receptors. Such assays may include cell-based assays, including assays for proliferation, cell death, apoptosis and cell migration. The binding affinity of the subject compositions for the target ligands can be assayed using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. The binding affinity constant can then be determined using standard methods, such as Scatchard analysis, as described by van Zoelen, et al., Trends Pharmacol Sciences (1998) 19)12):487, or other methods known in the art.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present disclosure, antagonists may include proteins, nucleic acids, carbohydrates, antibodies or any other molecules that decrease the effect of a biologically active protein.

A "target cell marker" refers to a molecule expressed by a target cell including but not limited to cell-surface receptors, cytokine receptors, antigens, tumor-associated antigens, glycoproteins, oligonucleotides, enzymatic substrates, antigenic determinants, or binding sites that may be present in the on the surface of a target tissue or cell that may serve as ligands for a binding moiety. Non-limiting examples of target cell markers include the target markers of Table 5.

A "target tissue" refers to a tissue that is the cause of or is part of a disease condition such as, but not limited to cancer or inflammatory conditions. Sources of diseased target tissue include a body organ, a tumor, a cancerous cell or population of cancerous cells or cells that form a matrix or are found in association with a population of cancerous cells, bone, skin, cells that produce cytokines or factors contributing to a disease condition.

A "defined medium" refers to a medium comprising nutritional and hormonal requirements necessary for the survival and/or growth of the cells in culture such that the components of the medium are known. Traditionally, the defined medium has been formulated by the addition of nutritional and growth factors necessary for growth and/or survival. Typically, the defined medium provides at least one component from one or more of the following categories: a) all essential amino acids, and usually the basic set of twenty amino acids plus cysteine; b) an energy source, usually in the form of a carbohydrate such as glucose; c) vitamins and/or other organic compounds required at low concentrations; d) free fatty acids; and e) trace elements, where trace elements are defined as inorganic compounds or naturally occurring elements that are typically required at very low concentrations, usually in the micromolar range. The defined medium may also optionally be supplemented with one or more components from any of the following categories: a) one or more mitogenic agents; b) salts and buffers as, for example, calcium, magnesium, and phosphate; c) nucleosides and bases such as, for example, adenosine and thymidine, hypoxanthine; and d) protein and tissue hydrolysates.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

As used herein, "treatment" or "treating," or "palliating" or "ameliorating" is used interchangeably herein. These terms refer to an approach for obtaining beneficial or desired results including but not limited to a therapeutic benefit and/or a prophylactic benefit. By therapeutic benefit is meant eradication or amelioration of the underlying disorder being treated. Also, a therapeutic benefit is achieved with the eradication or amelioration of one or more of the physiological symptoms or improvement in one or more clinical parameters associated with the underlying disorder such that an improvement is observed in the subject, notwithstanding that the subject may still be afflicted with the underlying disorder. For prophylactic benefit, the compositions may be administered to a subject at risk of developing a particular disease, or to a subject reporting one or more of the physiological symptoms of a disease, even though a diagnosis of this disease may not have been made.

A "therapeutic effect" or "therapeutic benefit," as used herein, refers to a physiologic effect, including but not limited to the mitigation, amelioration, or prevention of disease or an improvement in one or more clinical parameters associated with the underlying disorder in humans or other animals, or to otherwise enhance physical or mental wellbeing of humans or animals, resulting from administration of a polypeptide of the disclosure other than the ability to induce the production of an antibody against an antigenic epitope possessed by the biologically active protein. For prophylactic benefit, the compositions may be administered to a subject at risk of developing a particular disease, a recurrence of a former disease, condition or symptom of the disease, or to a subject reporting one or more of the physiological symptoms of a disease, even though a diagnosis of this disease may not have been made.

The terms "therapeutically effective amount" and "therapeutically effective dose", as used herein, refer to an amount of a drug or a biologically active protein, either alone or as a part of a polypeptide composition, that is capable of having any detectable, beneficial effect on any symptom, aspect, measured parameter or characteristics of a disease state or condition when administered in one or repeated doses to a subject. Such effect need not be absolute to be beneficial. Determination of a therapeutically effective amount is well within the capability of those skilled in the art, especially in light of the detailed disclosure provided herein.

The term "equivalent molar dose" means that the amounts of materials administered to a subject have an equivalent amount of moles, based on the molecular weight of the material used in the dose.

The term "therapeutically effective and non-toxic dose" as used herein refers to a tolerable dose of the compositions as defined herein that is high enough to cause depletion of tumor or cancer cells, tumor elimination, tumor shrinkage or stabilization of disease without or essentially without major toxic effects in the subject. Such therapeutically effective and non-toxic doses may be determined by dose escalation studies described in the art and should be below the dose inducing severe adverse side effects.

The term "dose regimen", as used herein, refers to a schedule for consecutively administered multiple doses (i.e., at least two or more) of a composition, wherein the doses are given in therapeutically effective amounts to result in sustained beneficial effect on any symptom, aspect, measured parameter, endpoint, or characteristic of a disease state or condition.

The terms "cancer" and "cancerous" refer to or describe the physiological condition in mammals that is typically characterized by unregulated cell growth/proliferation. Examples of cancer include, but are not limited to, carcinomas, Hodgkin's lymphoma, non-Hodgkin's lymphoma, B cell lymphoma, T-cell lymphoma, follicular lymphoma, mantle cell lymphoma, blastoma, breast cancer, colon cancer, prostate cancer, head and neck cancer, any form of skin cancer, melanoma, genito-urinary tract cancer, ovarian cancer, ovarian cancer with malignant ascites, peritoneal carcinomatosis, uterine serous carcinoma, endometrial cancer, cervical cancer, colorectal cancer, an epithelia intraperitoneal malignancy with malignant ascites, uterine cancer, mesothelioma in the peritoneum kidney cancers, lung cancer, small-cell lung cancer, non-small cell lung cancer, gastric cancer, esophageal cancer, stomach cancer, small intestine cancer, liver cancer, hepatocarcinoma, hepatoblastoma, liposarcoma, pancreatic cancer, gall bladder cancer, cancers of the bile duct, salivary gland carcinoma, thyroid cancer, epithelial cancer, adenocarcinoma, sarcomas of any origin, primary hematologic malignancies including acute or chronic lymphocytic leukemias, acute or chronic myelogenous leukemias, myeloproliferative neoplastic disorders, or myelodysplastic disorders, myasthenia gravis, Morbus Basedow, Hashimoto thyroiditis, or Goodpasture syndrome.

"Tumor-specific marker" as used herein, refers to an antigen that is found on or in a cancer cell.

"Target cell" refers to a cell that has the ligand of a binding moiety, an antibody or antibody fragment of the subject compositions and is associated with or causes a disease or pathologic condition, including cancer cells, tumor cells, and inflammatory cells. The ligand of a target cell is referred to herein as a "target cell marker" or "target cell antigen" and includes, but is not limited to, cell surface receptors or antigens, cytokines, cytokine receptors, MHC proteins, and cytosol proteins or peptides that are exogenously presented. As used herein, "target cell" would not include an effector cell.

I. General Techniques

The practice of the present disclosure employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," $3^{rd}$ edition, Cold Spring Harbor Laboratory Press, 2001; "Current protocols in molecular biology", F. M. Ausubel, et al. eds.,1987; the series "Methods in Enzymology," Academic Press, San Diego, CA.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," $11^{th}$ Edition, McGraw-Hill, 2005; and Freshney, R. I., "Culture of Animal Cells: A Manual of Basic Technique," $4^{th}$ edition, John Wiley & Sons, Somerset, NJ, 2000, the contents of which are incorporated in their entirety herein by reference.

Host cells can be cultured in a variety of media. Commercially available media such as Ham's F10 (Sigma), Minimal Essential Medium (MEM, Sigma), RPMI-1640 (Sigma), and Dulbecco's Modified Eagle's Medium (DMEM, Sigma) are suitable for culturing eukaryotic cells. In addition, animal cells can be grown in a defined medium that lacks serum but is supplemented with hormones, growth factors or any other factors necessary for the survival and/or growth of a particular cell type. Whereas a defined medium supporting cell survival maintains the viability, morphology, capacity to metabolize and potentially, capacity of the cell to differentiate, a defined medium promoting cell growth provides all chemicals necessary for cell proliferation or multiplication. The general parameters governing mammalian cell survival and growth in vitro are well established in the art. Physicochemical parameters which may be controlled in different cell culture systems are, e.g., pH, $pO_2$, temperature, and osmolarity. The nutritional requirements of cells are usually provided in standard media formulations developed to provide an optimal environment. Nutrients can be divided into several categories: amino acids and their derivatives, carbohydrates, sugars, fatty acids, complex lipids, nucleic acid derivatives and vitamins. Apart from nutrients for maintaining cell metabolism, most cells also require one or more hormones from at least one of the following groups: steroids, prostaglandins, growth factors, pituitary hormones, and peptide hormones to proliferate in serum-free media (Sato, G. H., et al. in "Growth of Cells in Hormonally Defined Media", Cold Spring Harbor Press, N.Y., 1982). In addition to hormones, cells may require transport proteins such as transferrin (plasma iron transport protein), ceruloplasmin (a copper transport protein), and high-density lipoprotein (a lipid carrier) for survival and growth in vitro. The set of optimal hormones or transport proteins will vary for each cell type. Most of these hormones or transport proteins have been added exogenously or, in a rare case, a mutant cell line has been found which does not require a particular factor. Those skilled in the art will know of other factors required for maintaining a cell culture without undue experimentation.

Growth media for growth of prokaryotic host cells include nutrient broths (liquid nutrient medium) or LB medium (Luria Bertani). Suitable media include defined and undefined media. In general, media contains a carbon source such as glucose needed for bacterial growth, water, and salts. Media may also include a source of amino acids and nitrogen, for example beef or yeast extract (in an undefined medium) or known quantities of amino acids (in a defined medium). In one embodiment, the growth medium is LB broth, for example LB Miller broth or LB Lennox broth. LB broth comprises peptone (enzymatic digestion product of casein), yeast extract and sodium chloride. In one embodiment, a selective medium is used which comprises an antibiotic. In this medium, only the desired cells possessing resistance to the antibiotic will grow.

II. Recombinant Polypeptides and Activatable Antibody Compositions

The present disclosure provides recombinant polypeptides comprising at least three categories of components; binding moieties, release segments (RS) and bulking moieties; each of which are described more fully herein. The disclosure also provides configurations of recombinant polypeptides that are specifically designed to confer pharmaceutical and therapeutic advantageous properties on the compositions in comparison to conventional antibody- and cytokine-based therapeutics.

In a first aspect, the disclosure provides recombinant polypeptide compositions having a first binding moiety (FBM) designed to bind a target ligand, a release segment that is a substrate for a mammalian protease, and a bulking moiety such as an XTEN, wherein the FBM is an antibody, a cytokine, a cell receptor, or a fragment thereof. The recombinant polypeptides comprising a single binding moiety may be designed to confer a prodrug property on the composition in order to render it less reactive when in the circulation or when exposed to healthy tissues, but when in proximity to diseased tissues or cells that produce or have co-localized proteases that are capable of cleaving the RS incorporated into the recombinant polypeptide, the FBM and XTEN are released such that the XTEN no longer shields the FBM and the FBM regains its full potential for binding affinity for its ligand. In some embodiments, FBM suitable for incorporation into the subject compositions include cytokines, chemokines and interleukins (such as but not limited to interleukin-1 (IL-1), IL-12, and IL-18, tumor necrosis factor (TNF), interferon gamma (IFN-gamma), granulocyte-macrophage colony stimulating factor, C-C chemokines (RANTES, monocyte chemoattractant protein or MCP-1, monocyte inflammatory protein or MIP-1α, and MIP-1β), C—X—C chemokines (IL-8 also called growth related oncogene or GRO/KC), C chemokines (lymphotactin), and CXXXC chemokines (fractalkine). In other embodiments, FBM suitable for incorporation into the subject compositions include antibody fragments that have binding affinity tumor associated antigens, including but not limited to the target cell markers of Table 5. In the foregoing embodiments, the recombinant polypeptides further comprise RS1 of Tables 1 or 2 and XTEN of Tables 8 or 10, or sequence variants thereof (as described more fully, below).

In a second aspect, the disclosure provides recombinant polypeptide compositions comprising two antibody fragments, one or more release segments, and one or more XTEN that are activatable by cleavage of the release segments such that the antibody fragments are released from the composition and regain their full potential for binding affinity for their respective ligands. Such recombinant polypeptides having two antibody fragments are also referred to herein as activatable antibody compositions (AAC). In one embodiment, an AAC having a first binding moiety (FBM) fused to a second binding moiety (SBM) in which the FBM and SBM are both antibody fragments, further comprises at least a first release segment and at least a first XTEN.

The AAC constructs described herein confer multiple therapeutic advantages over traditional monoclonal antibodies and other smaller bispecific molecules. Of particular note is the conditional activation of the AAC of the present disclosure. The intact, uncleaved AAC have a reduced ability to bind their intended target cell markers due to the shielding effect of the bulky, unstructured XTEN tethered to the AAC by the release segment. Thus, the specific activity to non-diseased, normal tissue of the exemplary compositions of the disclosure is significantly reduced when compared to that of analogous antibodies and antibody fragments. The ability of the AAC polypeptides to activate at their desired site of action (e.g., the proximity of a diseased tissue such as a tumor or cancer cell) while remaining essentially inactive during their progress to this site is an advance in the field of immune-oncologic therapeutics, offering the promise of potent and specific therapeutics with improved therapeutic index, as well as a readily designable and manufacturable format that can be applied to multiple target cells such as those disclosed herein.

The AAC described herein with a FBM and SBM antibody fragment are designed to allow specific targeting and killing of cells expressing a target cell marker by recruiting cytotoxic effector cells, e.g., T cells. The intact, uncleaved AAC is in a prodrug form in that the XTEN shields the binding moieties, reducing their binding affinity towards their ligands until released from the composition by protease cleavage of any of the protease cleavage sites located within the RS. This improves the specificity of the composition towards diseased tissues or cells compared to bispecific T-cell engager therapeutics that are not in a prodrug format. In contrast, by activating the AAC specifically in the microenvironment of the target cell or diseased tissue, where the target cell marker and proteases capable of cleaving the RS are highly expressed, the bispecific binding moieties and XTEN of the AAC constructs are released upon cleavage of the RS and the fused FBM and SBM antibody fragments can crosslink cytotoxic effector cells with cells expressing a target cell marker in a highly specific fashion, thereby directing the cytotoxic potential of the T cell towards the target cell.

In an exemplary feature of the AAC, once released, the fused FBM-SBM antibody fragment, having a much smaller size compared to the uncleaved AAC, is then free to permeate the target sites, e.g., a tumor mass, in order to reach and bind to and link together the target cell and cytotoxic T cell. Additionally, the entire process is not dependent upon internalization of the composition. In one embodiment, the AAC constructs described herein engage cytotoxic T cells via binding to the surface-expressed CD3, which forms part of the T cell receptor complex, causing T cell activation that mediates the subsequent lysis of the cell expressing the particular target cell marker. Thus, AAC are contemplated to display strong, specific and efficient target cell killing.

Without being bound by theory, it is believed that the AAC described herein stimulate target cell killing by cytotoxic effector cells to eliminate the cells expressing the particular target cell marker bound by the target-specific targeting moiety of the AAC in protease-rich microenvironments (e.g., tumors). In such case, cells are eliminated selectively, thereby reducing the potential for toxic side effects. Proteases known to be associated with diseased cells or tissues include but are not limited to serine proteases, cysteine proteases, aspartate proteases, and metalloproteases.

The AAC of the disclosure may confer further therapeutic and pharmaceutical advantages over recognized monoclonal antibodies and other smaller bispecific molecules. Conventional bi-specific molecules are designed to bind to a target cell having a cell-specific marker associated with a pathogenic cell. Toxicity and undesirable side effects are possible when, in some cases, healthy cells or tissues express the same marker as the target cell. One benefit to an AAC of the disclosure is that binding to CD3 and the target cells is enhanced upon the release of the binding moieties by a protease expressed by, or in association with, the disease tissue harboring the target cell, such as a tumor cell, permitting the binding of the released fused FBM and SBM antibody fragments to the target cell marker and the effector cell, creating an immunologic synapse. With reference to FIGS. 11 and 12, in exemplary embodiments, the two antibody fragment binding moieties of the AAC are fused to each other by a short linker, and are, in turn, connected to the XTEN by the release segment having one or more cleavage sites to allow the release of the fused FBM and SBM antibody fragments from the XTEN upon cleavage by one or more proteases co-localized with the diseased tissue. The binding moieties of the AAC may be in any format of a single chain binding moiety including Fv, Fab, Fab', Fab'-SH, F(ab')2, linear antibodies, a single domain antibody, a single domain antibody, and single-chain variable fragment antibody molecules (scFv). The two fused antibody fragments FBM and SBM can also be configured in a single chain diabody format by the selective arrangement of the VL and VH and the linkers that join them.

Polypeptide compositions capable of binding diseased tissues such as tumors have an optimal size for enhanced tissue penetration and distribution of the therapeutic. However, this is counterbalanced by the desire to have reduced first pass renal clearance as well as reduced extravasation from the circulation in normal tissue. Because the kidney generally filters out molecules below about 50 kDa, efforts to reduce clearance in the design of protein therapeutics have focused on increasing molecular size through fusions with proteins like albumin or the addition of polyethylene glycol polymers. However, while increasing the size of a protein therapeutic may prevent renal clearance and extravasation, the larger size also hinders penetration of the molecule into the target tissues. Exemplary AAC described herein avoid this by fusion of the binding moieties with release segments and bulking moieties such as XTEN, which greatly increase the apparent molecular weight of the composition (described more fully, below), and will prevent rapid renal clearance and extravasation in normal vasculature while having the ability to have the XTEN be released by the action of target tissue associated proteases on the RS, resulting in the release of the binding moieties having a small size, allowing for enhanced tissue penetration and distribution and optimal efficacy. Thus, the XTEN confers a number of favorable properties on the AAC embodiments, including but not limited to increased half-life, reduced extravasation in normal vasculature, increased solubility, reduced binding to healthy tissues, increased therapeutic index, and a prodrug format.

In an exemplary embodiment, the present disclosure provides AAC having a single chain binding moiety polypeptide directed to a ligand of a target cell and another single chain binding moiety polypeptide directed to an effector cell ligand, such as a CD3 antigen, making the configuration of this component of the AAC similar to bifunctional binding compositions such as blinatumomab (referred to as a BiTE® composition). A representative target cell marker is an antigen found on the surface of a cancer cell, e.g., EGFR, EpCAM, HER2, or any of the target markers of Table 5. In the embodiments, the AAC polypeptides comprise a FBM and a SBM, which can be scFv linked through a flexible linker such as those of Table 7, or can be configured as a single chain diabody. While each of the FBM and SBM have binding affinity for their respective ligands comparable to typical single chain binding moieties, the XTEN of the intact, uncleaved AAC composition serves to greatly reduce the ability of both scFv of the intact composition to bind their respective ligands by steric hindrance due to the ability of the flexible, unstructured XTEN to surround the binding moieties of the composition. Upon protease cleavage of the RS at any of the protease cleavage sites, the fused binding moieties separate from the XTEN, allowing the fused anti-target binding moiety and the anti-CD3 binding moiety to cooperatively bind their respective ligands and form an immunologic synapse between the target cell and the effector T cell. In those embodiments in which the recombinant polypeptide contains a single anti-target binding moiety, such as a cytokine or anti-cytokine, the released binding moiety would similarly have an enhanced ability to bind its ligand upon release from the intact composition by action of a protease on the RS.

III. Release Segments

In another aspect, the disclosure provides release segment (RS) peptides that are substrates for one or more mammalian proteases associated with or produced by disease tissues or cells found in proximity to disease tissues. Such proteases can include, but not be limited to the classes of proteases such as metalloproteinases, cysteine proteases, aspartate proteases, and serine proteases, including, but not limited to, the proteases of Table 3. The RS are useful for, amongst other things, incorporation into the subject recombinant polypeptides, conferring a prodrug format that can be activated by the cleavage of the RS by mammalian proteases. As described herein, the RS are incorporated into the subject recombinant polypeptide compositions, linking the incorporated binding moieties to the XTEN (the configurations of which are described more fully, below) such that upon cleavage of the RS by action of the one or more proteases for which the RS are substrates, the binding moieties and XTEN are released from the composition and the binding moieties, no longer shielded by the XTEN, regain their full potential to bind their ligands. In those recombinant polypeptide compositions comprising a first and a second antibody fragment, the compositions are also referred to herein as activatable antibody compositions (AAC).

In one embodiment, the disclosure provides activatable recombinant polypeptides comprising a first release segment (RS1) sequence having at least 88%, or at least 94%, or 100% sequence identity, when optimally aligned, to a sequence selected from the sequences set forth in Table 1, wherein the RS1 is a substrate for one or more mammalian proteases. In other embodiments, the disclosure provides activatable recombinant polypeptides comprising a RS1 and a second release segment (RS2) sequence, each having at least 88%, or at least 94%, or 100% sequence identity, when optimally aligned, to a sequence selected from the sequences set forth in Table 1, wherein the RS1 and the RS2 each are a substrate for one or more mammalian proteases. In another embodiment, disclosure provides activatable recombinant polypeptides comprising a first RS (RS1) sequence having at least 90%, at least 93%, at least 97%, or 100% identity, when optimally aligned, to a sequence selected from the sequences set forth in Table 2, wherein the RS is a substrate for one or more mammalian proteases. In other embodiments, the disclosure provides activatable recombinant polypeptides comprising a RS1 and a second release segment (RS2) sequence, each having at least 88%, or at least 94%, or 100% sequence identity, when optimally aligned, to a sequence selected from the sequences set forth in Table 2, wherein the RS1 and the RS2 are each a substrate for one or more mammalian proteases. In the embodiments of activatable recombinant polypeptides comprising RS1 and RS2, the two release segments can be identical or the sequences can be different.

The present disclosure contemplates release segments that are substrates for one, two or three different classes of proteases selected from metalloproteinases, cysteine proteases, aspartate proteases, and serine proteases, including the proteases of Table 3. In a particular feature, the RS serve as substrates for proteases found in close association with or are co-localized with disease tissues or cells, such as but not limited to tumors, cancer cells, and inflammatory tissues, and upon cleavage of the RS, the binding moieties that are otherwise shielded by the XTEN of the subject recombinant polypeptide compositions (and thus have a lower binding affinity for their respective ligands) are released from the composition and regain their full potential to bind the target and/or effector cell ligands. In another embodiment, the RS of the subject recombinant polypeptide compositions comprises an amino acid sequence that is a substrate for a cellular protease located within a targeted cell, including but not limited to the proteases of Table 3. In another particular feature of the subject recombinant polypeptide compositions, the RS that are substrates for two or three classes of proteases were designed with sequences that are capable of being cleaved in different locations of the RS sequence by the different proteases, with a representative example depicted in FIG. 36. Thus, the RS that are substrates for two, three, or more classes of proteases have two, three, or a plurality of distinct cleavage sites in the RS sequence, but cleavage by a single protease nevertheless results in the release of the binding moieties and the XTEN from the recombinant polypeptide composition comprising the RS.

In one embodiment, the RS of the disclosure for incorporation into the subject recombinant polypeptide compositions is a substrate for one or more proteases selected from the group consisting of meprin, neprilysin (CD10), PSMA, BMP-1, A disintegrin and metalloproteinases (ADAMs), ADAM8, ADAM9, ADAM10, ADAM12, ADAM15, ADAM17 (TACE), ADAM19, ADAM28 (MDC-L), ADAM with thrombospondin motifs (ADAMTS), ADAMTS1, ADAMTS4, ADAMTS5, MMP-1 (collagenase 1), matrix metalloproteinase-1 (MMP-1), matrix metalloproteinase-2 (MMP-2, gelatinase A), matrix metalloproteinase-3 (MMP-3, stromelysin 1), matrix metalloproteinase-7 (MMP-7, Matrilysin 1), matrix metalloproteinase-8 (MMP-8, collagenase 2), matrix metalloproteinase-9 (MMP-9, gelatinase B), matrix metalloproteinase-10 (MMP-10, stromelysin 2), matrix metalloproteinase-11 (MMP-11, stromelysin 3), matrix metalloproteinase-12 (MMP-12, macrophage elastase), matrix metalloproteinase-13 (MMP-13, collagenase 3), matrix metalloproteinase-14 (MMP-14, MT1-MMP), matrix metalloproteinase-15 (MMP-15, MT2-MMP), matrix metalloproteinase-19 (MMP-19), matrix metalloproteinase-23 (MMP-23, CA-MMP), matrix metalloproteinase-24 (MMP-24, MT5-MMP), matrix metalloproteinase-26 (MMP-26, matrilysin 2), matrix metalloproteinase-27 (MMP-27, CMMP), legumain, cathepsin B, cathepsin C, cathepsin K, cathepsin L, cathepsin S, cathepsin X, cathepsin D, cathepsin E, secretase, urokinase (uPA), tissue-type plasminogen activator (tPA), plasmin, thrombin, prostate-specific antigen (PSA, KLK3), human neutrophil elastase (HNE), elastase, tryptase, Type II transmembrane serine proteases (TTSPs), DESC1, hepsin (HPN), matriptase, matriptase-2, TMPRSS2, TMPRSS3, TMPRSS4 (CAP2), fibroblast activation protein (FAP), kallikrein-related peptidase (KLK family), KLK4, KLK5, KLK6, KLK7, KLK8, KLK10, KLK11, KLK13, and KLK14. In one embodiment, the RS is a substrate for ADAM17. In one embodiment, the RS is a substrate for BMP-1. In one embodiment, the RS is a substrate for cathepsin. In one embodiment, the RS is a substrate for HtrA1. In one embodiment, the RS is a substrate for legumain. In one embodiment, the RS is a substrate for MMP-1. In one embodiment, the RS is a substrate for MMP-2. In one embodiment, the RS is a substrate for MMP-7. In one embodiment, the RS is a substrate for MMP-9. In one embodiment, the RS is a substrate for MMP-11. In one embodiment, the RS is a substrate for MMP-14. In one embodiment, the RS is a substrate for uPA. In one embodiment, the RS is a substrate for matriptase. In one embodiment, the RS is a substrate for MT-SP1. In one embodiment, the RS is a substrate for neutrophil elastase. In one embodiment, the RS is a substrate for thrombin. In one embodiment RS is a substrate for TMPRSS3. In one embodiment, the RS is a substrate for TMPRSS4. In one embodiment, the RS of the subject recombinant polypeptide compositions is a substrate for at least two proteases selected from the group consisting of legumain, MMP-1, MMP-2, MMP-7, MMP-9, MMP-11, MMP-14, uPA, and matriptase. In another embodiment, the RS of the subject recombinant polypeptide compositions is a substrate for legumain, MMP-1, MMP-2, MMP-7, MMP-9, MMP-11, MMP-14, uPA, and matriptase.

TABLE 1

Release Segment Sequences.

| Name | Construct ID | Amino Acid Sequence | SEQ ID NO: |
|---|---|---|---|
| RSR-1517 | AC1611 | EAGRSANHEPLGLVAT | 1 |
| BSRS-A1 | AC1605 | ASGRSTNAGPSGLAGP | 2 |
| BSRS-A2 | AC1606 | ASGRSTNAGPQGLAGQ | 3 |
| BSRS-A3 | AC1607 | ASGRSTNAGPPGLTGP | 4 |
| VP-1 | AC1608 | ASSRGTNAGPAGLTGP | 5 |
| RSR-1752 | AC1609 | ASSRTTNTGPSTLTGP | 6 |
| RSR-1512 | AC1610 | AAGRSDNGTPLELVAP | 7 |
| RSR-1517 | AC1611 | EAGRSANHEPLGLVAT | 1 |
| VP-2 | AC1612 | ASGRGTNAGPAGLTGP | 8 |
| RSR-1018 | AC1613 | LFGRNDNHEPLELGGG | 9 |
| RSR-1053 | AC1614 | TAGRSDNLEPLGLVFG | 10 |
| RSR-1059 | AC1615 | LDGRSDNFHPPELVAG | 11 |
| RSR-1065 | AC1616 | LEGRSDNEEPENLVAG | 12 |
| RSR-1167 | AC1617 | LKGRSDNNAPLALVAG | 13 |
| RSR-1201 | AC1618 | VYSRGTNAGPHGLTGR | 14 |
| RSR-1218 | AC1619 | ANSRGTNKGFAGLIGP | 15 |
| RSR-1226 | AC1620 | ASSRLTNEAPAGLTIP | 16 |
| RSR-1254 | AC1621 | DQSRGTNAGPEGLTDP | 17 |
| RSR-1256 | AC1622 | ESSRGTNIGQGGLTGP | 18 |
| RSR-1261 | AC1623 | SSSRGTNQDPAGLTIP | 19 |
| RSR-1293 | AC1624 | ASSRGQNHSPMGLTGP | 20 |
| RSR-1309 | AC1625 | AYSRGPNAGPAGLEGR | 21 |
| RSR-1326 | AC1626 | ASERGNNAGPANLTGF | 22 |
| RSR-1345 | AC1627 | ASHRGTNPKPAILTGP | 23 |
| RSR-1354 | AC1628 | MSSRRTNANPAQLTGP | 24 |
| RSR-1426 | AC1629 | GAGRTDNHEPLELGAA | 25 |
| RSR-1478 | AC1630 | LAGRSENTAPLELTAG | 26 |
| RSR-1479 | AC1631 | LEGRPDNHEPLALVAS | 27 |
| RSR-1496 | AC1632 | LSGRSDNEEPLALPAG | 28 |
| RSR-1508 | AC1633 | EAGRTDNHEPLELSAP | 29 |
| RSR-1513 | AC1634 | EGGRSDNHGPLELVSG | 30 |
| RSR-1516 | AC1635 | LSGRSDNEAPLELEAG | 31 |
| RSR-1524 | AC1636 | LGGRADNHEPPELGAG | 32 |

TABLE 1-continued

Release Segment Sequences.

| Name | Construct ID | Amino Acid Sequence | SEQ ID NO: |
|---|---|---|---|
| RSR-1622 | AC1637 | PPSRGTNAEPAGLTGE | 33 |
| RSR-1629 | AC1638 | ASTRGENAGPAGLEAP | 34 |
| RSR-1664 | AC1639 | ESSRGTNGAPEGLTGP | 35 |
| RSR-1667 | AC1640 | ASSRATNESPAGLTGE | 36 |
| RSR-1709 | AC1641 | ASSRGENPPPGGLTGP | 37 |
| RSR-1712 | AC1642 | AASRGTNTGPAELTGS | 38 |
| RSR-1727 | AC1643 | AGSRTTNAGPGGLEGP | 39 |
| RSR-1754 | AC1644 | APSRGENAGPATLTGA | 40 |
| RSR-1819 | AC1645 | ESGRAANTGPPTLTAP | 41 |
| RSR-1832 | AC1646 | NPGRAANEGPPGLPGS | 42 |
| RSR-1855 | AC1647 | ESSRAANLTPPELTGP | 43 |
| RSR-1911 | AC1648 | ASGRAANETPPGLTGA | 44 |
| RSR-1929 | AC1649 | NSGRGENLGAPGLTGT | 45 |
| RSR-1951 | AC1650 | TTGRAANLTPAGLTGP | 46 |
| RSR-2295 | AC1761 | EAGRSANHTPAGLTGP | 47 |
| RSR-2298 | AC1762 | ESGRAANTTPAGLTGP | 48 |
| RSR-2038 | AC1679 | TTGRATEAANLTPAGLTGP | 49 |
| RSR-2072 | AC1680 | TTGRAEEAANLTPAGLTGP | 50 |
| RSR-2089 | AC1681 | TTGRAGEAANLTPAGLTGP | 51 |
| RSR-2302 | AC1682 | TTGRATEAANATPAGLTGP | 52 |
| RSR-3047 | AC1697 | TTGRAGEAEGATSAGATGP | 53 |
| RSR-3052 | AC1698 | TTGEAGEAANATSAGATGP | 54 |
| RSR-3043 | AC1699 | TTGEAGEAAGLTPAGLTGP | 55 |
| RSR-3041 | AC1700 | TTGAAGEAANATPAGLTGP | 56 |
| RSR-3044 | AC1701 | TTGRAGEAAGLTPAGLTGP | 57 |
| RSR-3057 | AC1702 | TTGRAGEAANATSAGATGP | 58 |
| RSR-3058 | AC1703 | TTGEAGEAAGATSAGATGP | 59 |
| RSR-2485 | AC1763 | ESGRAANTEPPELGAG | 60 |
| RSR-2486 | AC1764 | ESGRAANTAPEGLTGP | 61 |
| RSR-2488 | AC1688 | EPGRAANHEPSGLTEG | 62 |
| RSR-2599 | AC1706 | ESGRAANHTGAPPGGLTGP | 63 |
| RSR-2706 | AC1716 | TTGRTGEGANATPGGLTGP | 64 |
| RSR-2707 | AC1717 | RTGRSGEAANETPEGLEGP | 65 |
| RSR-2708 | AC1718 | RTGRTGESANETPAGLGGP | 66 |
| RSR-2709 | AC1719 | STGRTGEPANETPAGLSGP | 67 |
| RSR-2710 | AC1720 | TTGRAGEPANATPTGLSGP | 68 |
| RSR-2711 | AC1721 | RTGRPGEGANATPTGLPGP | 69 |
| RSR-2712 | AC1722 | RTGRGGEAANATPSGLGGP | 70 |

TABLE 1-continued

Release Segment Sequences.

| Name | Construct ID | Amino Acid Sequence | SEQ ID NO: |
|---|---|---|---|
| RSR-2713 | AC1723 | STGRSGESANATPGGLGGP | 71 |
| RSR-2714 | AC1724 | RTGRTGEEANATPAGLPGP | 72 |
| RSR-2715 | AC1725 | ATGRPGEPANTTPEGLEGP | 73 |
| RSR-2716 | AC1726 | STGRSGEPANATPGGLTGP | 74 |
| RSR-2717 | AC1727 | PTGRGGEGANTTPTGLPGP | 75 |
| RSR-2718 | AC1728 | PTGRSGEGANATPSGLTGP | 76 |
| RSR-2719 | AC1729 | TTGRASEGANSTPAPLTEP | 77 |
| RSR-2720 | AC1730 | TYGRAAEAANTTPAGLTAP | 78 |
| RSR-2721 | AC1731 | TTGRATEGANATPAELTEP | 79 |
| RSR-2722 | AC1732 | TVGRASEEANTTPASLTGP | 80 |
| RSR-2723 | AC1733 | TTGRAPEAANATPAPLTGP | 81 |
| RSR-2724 | AC1734 | TWGRATEPANATPAPLTSP | 82 |
| RSR-2725 | AC1735 | TVGRASESANATPAELTSP | 83 |
| RSR-2726 | AC1736 | TVGRAPEGANSTPAGLTGP | 84 |
| RSR-2727 | AC1737 | TWGRATEAPNLEPATLTTP | 85 |
| RSR-2728 | AC1738 | TTGRATEAPNLTPAPLTEP | 86 |
| RSR-2729 | AC1739 | TQGRATEAPNLSPAALTSP | 87 |
| RSR-2730 | AC1740 | TQGRAAEAPNLTPATLTAP | 88 |
| RSR-2731 | AC1741 | TSGRAPEATNLAPAPLTGP | 89 |
| RSR-2732 | AC1742 | TQGRAAEAANLTPAGLTEP | 90 |
| RSR-2733 | AC1743 | TTGRAGSAPNLPPTGLTTP | 91 |
| RSR-2734 | AC1744 | TTGRAGGAENLPPEGLTAP | 92 |
| RSR-2735 | AC1745 | TTSRAGTATNLTPEGLTAP | 93 |
| RSR-2736 | AC1746 | TTGRAGTATNLPPSGLTTP | 94 |
| RSR-2737 | AC1747 | TTARAGEAENLSPSGLTAP | 95 |
| RSR-2738 | AC1748 | TTGRAGGAGNLAPGGLTEP | 96 |
| RSR-2739 | AC1749 | TTGRAGTATNLPPEGLTGP | 97 |
| RSR-2740 | AC1750 | TTGRAGGAANLAPTGLTEP | 98 |
| RSR-2741 | AC1751 | TTGRAGTAENLAPSGLTTP | 99 |
| RSR-2742 | AC1752 | TTGRAGSATNLGPGGLTGP | 100 |
| RSR-2743 | AC1753 | TTARAGGAENLTPAGLTEP | 101 |
| RSR-2744 | AC1754 | TTARAGSAENLSPSGLTGP | 102 |
| RSR-2745 | AC1755 | TTARAGGAGNLAPEGLTTP | 103 |
| RSR-2746 | AC1756 | TTSRAGAAENLTPTGLTGP | 104 |
| RSR-2747 | AC1757 | TYGRTTTPGNEPPASLEAE | 105 |
| RSR-2748 | AC1758 | TYSRGESGPNEPPPGLTGP | 106 |
| RSR-2749 | AC1759 | AWGRTGASENETPAPLGGE | 107 |
| RSR-2750 | AC1760 | RWGRAETTPNTPPEGLETE | 108 |

TABLE 1-continued

Release Segment Sequences.

| Name | Construct ID | Amino Acid Sequence | SEQ ID NO: |
|---|---|---|---|
| RSR-2751 | AC1765 | ESGRAANHTGAEPPELGAG | 109 |
| RSR-2754 | AC1801 | TTGRAGEAANLTPAGLTES | 110 |
| RSR-2755 | AC1802 | TTGRAGEAANLTPAALTES | 111 |
| RSR-2756 | AC1803 | TTGRAGEAANLTPAPLTES | 112 |
| RSR-2757 | AC1804 | TTGRAGEAANLTPEPLTES | 113 |
| RSR-2758 | AC1805 | TTGRAGEAANLTPAGLTGA | 114 |
| RSR-2759 | AC1806 | TTGRAGEAANLTPEGLTGA | 115 |
| RSR-2760 | AC1807 | TTGRAGEAANLTPEPLTGA | 116 |
| RSR-2761 | AC1808 | TTGRAGEAANLTPAGLTEA | 117 |
| RSR-2762 | AC1809 | TTGRAGEAANLTPEGLTEA | 118 |
| RSR-2763 | AC1810 | TTGRAGEAANLTPAPLTEA | 119 |
| RSR-2764 | AC1811 | TTGRAGEAANLTPEPLTEA | 120 |
| RSR-2765 | AC1812 | TTGRAGEAANLTPEPLTGP | 121 |
| RSR-2766 | AC1813 | TTGRAGEAANLTPAGLTGG | 122 |
| RSR-2767 | AC1814 | TTGRAGEAANLTPEGLTGG | 123 |
| RSR-2768 | AC1815 | TTGRAGEAANLTPEALTGG | 124 |
| RSR-2769 | AC1816 | TTGRAGEAANLTPEPLTGG | 125 |
| RSR-2770 | AC1817 | TTGRAGEAANLTPAGLTEG | 126 |
| RSR-2771 | AC1818 | TTGRAGEAANLTPEGLTEG | 127 |
| RSR-2772 | AC1819 | TTGRAGEAANLTPAPLTEG | 128 |
| RSR-2773 | AC1820 | TTGRAGEAANLTPEPLTEG | 129 |

TABLE 2

Release Segment Sequences

| Name | Amino Acid Sequence | Name | Amino Acid Sequence |
|---|---|---|---|
| RSN-0001 (SEQ ID NO.: 130) | GSAPGSAGGYAELRMGGAIATSGSETPGT | RSC-0001 (SEQ ID NO.: 375) | GTAEAASASGGSAGGYAELRMGGAIPGSP |
| RSN-0002 (SEQ ID NO.: 131) | GSAPGTGGGYAPLRMGGGAATSGSETPGT | RSC-0002 (SEQ ID NO.: 376) | GTAEAASASGGTGGGYAPLRMGGGAPGSP |
| RSN-0003 (SEQ ID NO.: 132) | GSAPGAEGGYAALRMGGEIATSGSETPGT | RSC-0003 (SEQ ID NO.: 377) | GTAEAASASGGAEGGYAALRMGGEIPGSP |
| RSN-0004 (SEQ ID NO.: 133) | GSAPGGPGGYALLRMGGPAATSGSETPGT | RSC-0004 (SEQ ID NO.: 378) | GTAEAASASGGGPGGYALLRMGGPAPGSP |
| RSN-0005 (SEQ ID NO.: 134) | GSAPGEAGGYAFLRMGGSIATSGSETPGT | RSC-0005 (SEQ ID NO.: 379) | GTAEAASASGGEAGGYAFLRMGGSIPGSP |
| RSN-0006 (SEQ ID NO.: 135) | GSAPGPGGGYASLRMGGTAATSGSETPGT | RSC-0006 (SEQ ID NO.: 380) | GTAEAASASGGPGGGYASLRMGGTAPGSP |

TABLE 2-continued

Release Segment Sequences

| Name | Amino Acid Sequence | Name | Amino Acid Sequence |
|---|---|---|---|
| RSN-0007 (SEQ ID NO.: 136) | GSAPGSEGGYATLRMGGAI ATSGSETPGT | RSC-0007 (SEQ ID NO.: 381) | GTAEAASASGGSEGGYATLRMGGAI PGSP |
| RSN-0008 (SEQ ID NO.: 137) | GSAPGTPGGYANLRMGGGA ATSGSETPGT | RSC-0008 (SEQ ID NO.: 382) | GTAEAASASGGTPGGYANLRMGGGA PGSP |
| RSN-0009 (SEQ ID NO.: 138) | GSAPGASGGYAHLRMGGEI ATSGSETPGT | RSC-0009 (SEQ ID NO.: 383) | GTAEAASASGGASGGYAHLRMGGEI PGSP |
| RSN-0010 (SEQ ID NO.: 139) | GSAPGGTGGYGELRMGGPA ATSGSETPGT | RSC-0010 (SEQ ID NO.: 384) | GTAEAASASGGGTGGYGELRMGGPA PGSP |
| RSN-0011 (SEQ ID NO.: 140) | GSAPGEAGGYPELRMGGSI ATSGSETPGT | RSC-0011 (SEQ ID NO.: 385) | GTAEAASASGGEAGGYPELRMGGSI PGSP |
| RSN-0012 (SEQ ID NO.: 141) | GSAPGPGGGYVELRMGGTA ATSGSETPGT | RSC-0012 (SEQ ID NO.: 386) | GTAEAASASGGPGGGYVELRMGGTA PGSP |
| RSN-0013 (SEQ ID NO.: 142) | GSAPGSEGGYLELRMGGAI ATSGSETPGT | RSC-0013 (SEQ ID NO.: 387) | GTAEAASASGGSEGGYLELRMGGAI PGSP |
| RSN-0014 (SEQ ID NO.: 143) | GSAPGTPGGYSELRMGGGA ATSGSETPGT | RSC-0014 (SEQ ID NO.: 388) | GTAEAASASGGTPGGYSELRMGGGA PGSP |
| RSN-0015 (SEQ ID NO.: 144) | GSAPGASGGYTELRMGGEI ATSGSETPGT | RSC-0015 (SEQ ID NO.: 389) | GTAEAASASGGASGGYTELRMGGEI PGSP |
| RSN-0016 (SEQ ID NO.: 145) | GSAPGGTGGYQELRMGGPA ATSGSETPGT | RSC-0016 (SEQ ID NO.: 390) | GTAEAASASGGGTGGYQELRMGGPA PGSP |
| RSN-0017 (SEQ ID NO.: 146) | GSAPGEAGGYEELRMGGSI ATSGSETPGT | RSC-0017 (SEQ ID NO.: 391) | GTAEAASASGGEAGGYEELRMGGSI PGSP |
| RSN-0018 (SEQ ID NO.: 147) | GSAPGPGIGPAELRMGGTA ATSGSETPGT | RSC-0018 (SEQ ID NO.: 392) | GTAEAASASGGPGIGPAELRMGGTA PGSP |
| RSN-0019 (SEQ ID NO.: 148) | GSAPGSEIGAAELRMGGAI ATSGSETPGT | RSC-0019 (SEQ ID NO.: 393) | GTAEAASASGGSEIGAAELRMGGAI PGSP |
| RSN-0020 (SEQ ID NO.: 149) | GSAPGTPIGSAELRMGGGA ATSGSETPGT | RSC-0020 (SEQ ID NO.: 394) | GTAEAASASGGTPIGSAELRMGGGA PGSP |
| RSN-0021 (SEQ ID NO.: 150) | GSAPGASIGTAELRMGGEI ATSGSETPGT | RSC-0021 (SEQ ID NO.: 395) | GTAEAASASGGASIGTAELRMGGEI PGSP |
| RSN-0022 (SEQ ID NO.: 151) | GSAPGGTIGNAELRMGGPA ATSGSETPGT | RSC-0022 (SEQ ID NO.: 396) | GTAEAASASGGGTIGNAELRMGGPA PGSP |
| RSN-0023 (SEQ ID NO.: 152) | GSAPGEAIGQAELRMGGSI ATSGSETPGT | RSC-0023 (SEQ ID NO.: 397) | GTAEAASASGGEAIGQAELRMGGSI PGSP |
| RSN-0024 (SEQ ID NO.: 153) | GSAPGPGGPYAELRMGGTA ATSGSETPGT | RSC-0024 (SEQ ID NO.: 398) | GTAEAASASGGPGGPYAELRMGGTA PGSP |
| RSN-0025 (SEQ ID NO.: 154) | GSAPGSEGAYAELRMGGAI ATSGSETPGT | RSC-0025 (SEQ ID NO.: 399) | GTAEAASASGGSEGAYAELRMGGAI PGSP |

TABLE 2-continued

Release Segment Sequences

| Name | Amino Acid Sequence | Name | Amino Acid Sequence |
|---|---|---|---|
| RSN-0026 (SEQ ID NO.: 155) | GSAPGTPGVYAELRMGGGA ATSGSETPGT | RSC-0026 (SEQ ID NO.: 400) | GTAEAASASGGTPGVYAELRMGGGA PGSP |
| RSN-0027 (SEQ ID NO.: 156) | GSAPGASGLYAELRMGGEI ATSGSETPGT | RSC-0027 (SEQ ID NO.: 401) | GTAEAASASGGASGLYAELRMGGEI PGSP |
| RSN-0028 (SEQ ID NO.: 157) | GSAPGGTGIYAELRMGGPA ATSGSETPGT | RSC-0028 (SEQ ID NO.: 402) | GTAEAASASGGGTGIYAELRMGGPA PGSP |
| RSN-0029 (SEQ ID NO.: 158) | GSAPGEAGFYAELRMGGSI ATSGSETPGT | RSC-0029 (SEQ ID NO.: 403) | GTAEAASASGGEAGFYAELRMGGSI PGSP |
| RSN-0030 (SEQ ID NO.: 159) | GSAPGPGGYYAELRMGGTA ATSGSETPGT | RSC-0030 (SEQ ID NO.: 404) | GTAEAASASGGPGGYYAELRMGGTA PGSP |
| RSN-0031 (SEQ ID NO.: 160) | GSAPGSEGSYAELRMGGAI ATSGSETPGT | RSC-0031 (SEQ ID NO.: 405) | GTAEAASASGGSEGSYAELRMGGAI PGSP |
| RSN-0032 (SEQ ID NO.: 161) | GSAPGTPGNYAELRMGGGA ATSGSETPGT | RSC-0032 (SEQ ID NO.: 406) | GTAEAASASGGTPGNYAELRMGGGA PGSP |
| RSN-0033 (SEQ ID NO.: 162) | GSAPGASGEYAELRMGGEI ATSGSETPGT | RSC-0033 (SEQ ID NO.: 407) | GTAEAASASGGASGEYAELRMGGEI PGSP |
| RSN-0034 (SEQ ID NO.: 163) | GSAPGGTGHYAELRMGGPA ATSGSETPGT | RSC-0034 (SEQ ID NO.: 408) | GTAEAASASGGGTGHYAELRMGGPA PGSP |
| RSN-0035 (SEQ ID NO.: 164) | GSAPGEAGGYAEARMGGSI ATSGSETPGT | RSC-0035 (SEQ ID NO.: 409) | GTAEAASASGGEAGGYAEARMGGSI PGSP |
| RSN-0036 (SEQ ID NO.: 165) | GSAPGPGGGYAEVRMGGTA ATSGSETPGT | RSC-0036 (SEQ ID NO.: 410) | GTAEAASASGGPGGGYAEVRMGGTA PGSP |
| RSN-0037 (SEQ ID NO.: 166) | GSAPGSEGGYAEIRMGGAI ATSGSETPGT | RSC-0037 (SEQ ID NO.: 411) | GTAEAASASGGSEGGYAEIRMGGAI PGSP |
| RSN-0038 (SEQ ID NO.: 167) | GSAPGTPGGYAEFRMGGGA ATSGSETPGT | RSC-0038 (SEQ ID NO.: 412) | GTAEAASASGGTPGGYAEFRMGGGA PGSP |
| RSN-0039 (SEQ ID NO.: 168) | GSAPGASGGYAEYRMGGEI ATSGSETPGT | RSC-0039 (SEQ ID NO.: 413) | GTAEAASASGGASGGYAEYRMGGEI PGSP |
| RSN-0040 (SEQ ID NO.: 169) | GSAPGGTGGYAESRMGGPA ATSGSETPGT | RSC-0040 (SEQ ID NO.: 414) | GTAEAASASGGGTGGYAESRMGGPA PGSP |
| RSN-0041 (SEQ ID NO.: 170) | GSAPGEAGGYAETRMGGSI ATSGSETPGT | RSC-0041 (SEQ ID NO.: 415) | GTAEAASASGGEAGGYAETRMGGSI PGSP |
| RSN-0042 (SEQ ID NO.: 171) | GSAPGPGGGYAELAMGGTR ATSGSETPGT | RSC-0042 (SEQ ID NO.: 416) | GTAEAASASGGPGGGYAELAMGGTR PGSP |
| RSN-0043 (SEQ ID NO.: 172) | GSAPGSEGGYAELVMGGAR ATSGSETPGT | RSC-0043 (SEQ ID NO.: 417) | GTAEAASASGGSEGGYAELVMGGAR PGSP |
| RSN-0044 (SEQ ID NO.: 173) | GSAPGTPGGYAELLMGGGR ATSGSETPGT | RSC-0044 (SEQ ID NO.: 418) | GTAEAASASGGTPGGYAELLMGGGR PGSP |

TABLE 2-continued

Release Segment Sequences

| Name | Amino Acid Sequence | Name | Amino Acid Sequence |
|---|---|---|---|
| RSN-0045 (SEQ ID NO.: 174) | GSAPGASGGYAELIMGGER ATSGSETPGT | RSC-0045 (SEQ ID NO.: 419) | GTAEAASASGGASGGYAELIMGGER PGSP |
| RSN-0046 (SEQ ID NO.: 175) | GSAPGGTGGYAELWMGGPR ATSGSETPGT | RSC-0046 (SEQ ID NO.: 420) | GTAEAASASGGGTGGYAELWMGGPR PGSP |
| RSN-0047 (SEQ ID NO.: 176) | GSAPGEAGGYAELSMGGSR ATSGSETPGT | RSC-0047 (SEQ ID NO.: 421) | GTAEAASASGGEAGGYAELSMGGSR PGSP |
| RSN-0048 (SEQ ID NO.: 177) | GSAPGPGGGYAELTMGGTR ATSGSETPGT | RSC-0048 (SEQ ID NO.: 422) | GTAEAASASGGPGGGYAELTMGGTR PGSP |
| RSN-0049 (SEQ ID NO.: 178) | GSAPGSEGGYAELQMGGAR ATSGSETPGT | RSC-0049 (SEQ ID NO.: 423) | GTAEAASASGGSEGGYAELQMGGAR PGSP |
| RSN-0050 (SEQ ID NO.: 179) | GSAPGTPGGYAELNMGGGR ATSGSETPGT | RSC-0050 (SEQ ID NO.: 424) | GTAEAASASGGTPGGYAELNMGGGR PGSP |
| RSN-0051 (SEQ ID NO.: 180) | GSAPGASGGYAELEMGGER ATSGSETPGT | RSC-0051 (SEQ ID NO.: 425) | GTAEAASASGGASGGYAELEMGGER PGSP |
| RSN-0052 (SEQ ID NO.: 181) | GSAPGGTGGYAELRPGGPI ATSGSETPGT | RSC-0052 (SEQ ID NO.: 426) | GTAEAASASGGGTGGYAELRPGGPI PGSP |
| RSN-0053 (SEQ ID NO.: 182) | GSAPGEAGGYAELRAGGSA ATSGSETPGT | RSC-0053 (SEQ ID NO.: 427) | GTAEAASASGGEAGGYAELRAGGSA PGSP |
| RSN-0054 (SEQ ID NO.: 183) | GSAPGPGGGYAELRLGGTI ATSGSETPGT | RSC-0054 (SEQ ID NO.: 428) | GTAEAASASGGPGGGYAELRLGGTI PGSP |
| RSN-0055 (SEQ ID NO.: 184) | GSAPGSEGGYAELRIGGAA ATSGSETPGT | RSC-0055 (SEQ ID NO.: 429) | GTAEAASASGGSEGGYAELRIGGAA PGSP |
| RSN-0056 (SEQ ID NO.: 185) | GSAPGTPGGYAELRSGGGI ATSGSETPGT | RSC-0056 (SEQ ID NO.: 430) | GTAEAASASGGTPGGYAELRSGGGI PGSP |
| RSN-0057 (SEQ ID NO.: 186) | GSAPGASGGYAELRNGGEA ATSGSETPGT | RSC-0057 (SEQ ID NO.: 431) | GTAEAASASGGASGGYAELRNGGEA PGSP |
| RSN-0058 (SEQ ID NO.: 187) | GSAPGGTGGYAELRQGGPI ATSGSETPGT | RSC-0058 (SEQ ID NO.: 432) | GTAEAASASGGGTGGYAELRQGGPI PGSP |
| RSN-0059 (SEQ ID NO.: 188) | GSAPGEAGGYAELRDGGSA ATSGSETPGT | RSC-0059 (SEQ ID NO.: 433) | GTAEAASASGGEAGGYAELRDGGSA PGSP |
| RSN-0060 (SEQ ID NO.: 189) | GSAPGPGGGYAELREGGTI ATSGSETPGT | RSC-0060 (SEQ ID NO.: 434) | GTAEAASASGGPGGGYAELREGGTI PGSP |
| RSN-0061 (SEQ ID NO.: 190) | GSAPGSEGGYAELRHGGAA ATSGSETPGT | RSC-0061 (SEQ ID NO.: 435) | GTAEAASASGGSEGGYAELRHGGAA PGSP |
| RSN-0062 (SEQ ID NO.: 191) | GSAPGTPGGYAELRMPGGI ATSGSETPGT | RSC-0062 (SEQ ID NO.: 436) | GTAEAASASGGTPGGYAELRMPGGI PGSP |
| RSN-0063 (SEQ ID NO.: 192) | GSAPGASGGYAELRMAGEA ATSGSETPGT | RSC-0063 (SEQ ID NO.: 437) | GTAEAASASGGASGGYAELRMAGEA PGSP |

TABLE 2-continued

Release Segment Sequences

| Name | Amino Acid Sequence | Name | Amino Acid Sequence |
|---|---|---|---|
| RSN-0064 (SEQ ID NO.: 193) | GSAPGGTGGYAELRMVGPIATSGSETPGT | RSC-0064 (SEQ ID NO.: 438) | GTAEAASASGGGTGGYAELRMVGPIPGSP |
| RSN-0065 (SEQ ID NO.: 194) | GSAPGEAGGYAELRMLGSAATSGSETPGT | RSC-0065 (SEQ ID NO.: 439) | GTAEAASASGGEAGGYAELRMLGSAPGSP |
| RSN-0066 (SEQ ID NO.: 195) | GSAPGPGGGYAELRMIGTIATSGSETPGT | RSC-0066 (SEQ ID NO.: 440) | GTAEAASASGGPGGGYAELRMIGTIPGSP |
| RSN-0067 (SEQ ID NO.: 196) | GSAPGSEGGYAELRMYGAIATSGSETPGT | RSC-0067 (SEQ ID NO.: 441) | GTAEAASASGGSEGGYAELRMYGAIPGSP |
| RSN-0068 (SEQ ID NO.: 197) | GSAPGTPGGYAELRMSGGAATSGSETPGT | RSC-0068 (SEQ ID NO.: 442) | GTAEAASASGGTPGGYAELRMSGGAPGSP |
| RSN-0069 (SEQ ID NO.: 198) | GSAPGASGGYAELRMNGEIATSGSETPGT | RSC-0069 (SEQ ID NO.: 443) | GTAEAASASGGASGGYAELRMNGEIPGSP |
| RSN-0070 (SEQ ID NO.: 199) | GSAPGGTGGYAELRMQGPAATSGSETPGT | RSC-0070 (SEQ ID NO.: 444) | GTAEAASASGGGTGGYAELRMQGPAPGSP |
| RSN-0071 (SEQ ID NO.: 200) | GSAPGANHTPAGLTGPGARATSGSETPGT | RSC-0071 (SEQ ID NO.: 445) | GTAEAASASGGANHTPAGLTGPGARPGSP |
| RSN-0072 (SEQ ID NO.: 201) | GSAPGANTAPEGLTGPSTRATSGSETPGT | RSC-0072 (SEQ ID NO.: 446) | GTAEAASASGGANTAPEGLTGPSTRPGSP |
| RSN-0073 (SEQ ID NO.: 202) | GSAPGTGAPPGGLTGPGTRATSGSETPGT | RSC-0073 (SEQ ID NO.: 447) | GTAEAASASGGTGAPPGGLTGPGTRPGSP |
| RSN-0074 (SEQ ID NO.: 203) | GSAPGANHEPSGLTEGSPRATSGSETPGT | RSC-0074 (SEQ ID NO.: 448) | GTAEAASASGGANHEPSGLTEGSPRPGSP |
| RSN-0075 (SEQ ID NO.: 204) | GSAPGANTEPPELGAGTERATSGSETPGT | RSC-0075 (SEQ ID NO.: 449) | GTAEAASASGGANTEPPELGAGTERPGSP |
| RSN-0076 (SEQ ID NO.: 205) | GSAPGASGPPPGLTGPPGRATSGSETPGT | RSC-0076 (SEQ ID NO.: 450) | GTAEAASASGGASGPPPGLTGPPGRPGSP |
| RSN-0077 (SEQ ID NO.: 206) | GSAPGASGTPAPLGGEPGRATSGSETPGT | RSC-0077 (SEQ ID NO.: 451) | GTAEAASASGGASGTPAPLGGEPGRPGSP |
| RSN-0078 (SEQ ID NO.: 207) | GSAPGPAGPPEGLETEAGRATSGSETPGT | RSC-0078 (SEQ ID NO.: 452) | GTAEAASASGGPAGPPEGLETEAGRPGSP |
| RSN-0079 (SEQ ID NO.: 208) | GSAPGPTSGQGGLTGPESRATSGSETPGT | RSC-0079 (SEQ ID NO.: 453) | GTAEAASASGGPTSGQGGLTGPESRPGSP |
| RSN-0080 (SEQ ID NO.: 209) | GSAPGSAGGAANLVRGGAIATSGSETPGT | RSC-0080 (SEQ ID NO.: 454) | GTAEAASASGGSAGGAANLVRGGAIPGSP |
| RSN-0081 (SEQ ID NO.: 210) | GSAPGTGGGAAPLVRGGGAATSGSETPGT | RSC-0081 (SEQ ID NO.: 455) | GTAEAASASGGTGGGAAPLVRGGGAPGSP |
| RSN-0082 (SEQ ID NO.: 211) | GSAPGAEGGAAALVRGGEIATSGSETPGT | RSC-0082 (SEQ ID NO.: 456) | GTAEAASASGGAEGGAAALVRGGEIPGSP |

TABLE 2-continued

Release Segment Sequences

| Name | Amino Acid Sequence | Name | Amino Acid Sequence |
|---|---|---|---|
| RSN-0083 (SEQ ID NO.: 212) | GSAPGGPGGAALLVRGGPA ATSGSETPGT | RSC-0083 (SEQ ID NO.: 457) | GTAEAASASGGGPGGAALLVRGGPA PGSP |
| RSN-0084 (SEQ ID NO.: 213) | GSAPGEAGGAAFLVRGGSI ATSGSETPGT | RSC-0084 (SEQ ID NO.: 458) | GTAEAASASGGEAGGAAFLVRGGSI PGSP |
| RSN-0085 (SEQ ID NO.: 214) | GSAPGPGGGAASLVRGGTA ATSGSETPGT | RSC-0085 (SEQ ID NO.: 459) | GTAEAASASGGPGGGAASLVRGGTA PGSP |
| RSN-0086 (SEQ ID NO.: 215) | GSAPGSEGGAATLVRGGAI ATSGSETPGT | RSC-0086 (SEQ ID NO.: 460) | GTAEAASASGGSEGGAATLVRGGAI PGSP |
| RSN-0087 (SEQ ID NO.: 216) | GSAPGTPGGAAGLVRGGGA ATSGSETPGT | RSC-0087 (SEQ ID NO.: 461) | GTAEAASASGGTPGGAAGLVRGGGA PGSP |
| RSN-0088 (SEQ ID NO.: 217) | GSAPGASGGAADLVRGGEI ATSGSETPGT | RSC-0088 (SEQ ID NO.: 462) | GTAEAASASGGASGGAADLVRGGEI PGSP |
| RSN-0089 (SEQ ID NO.: 218) | GSAPGGTGGAGNLVRGGPA ATSGSETPGT | RSC-0089 (SEQ ID NO.: 463) | GTAEAASASGGGTGGAGNLVRGGPA PGSP |
| RSN-0090 (SEQ ID NO.: 219) | GSAPGEAGGAPNLVRGGSI ATSGSETPGT | RSC-0090 (SEQ ID NO.: 464) | GTAEAASASGGEAGGAPNLVRGGSI PGSP |
| RSN-0091 (SEQ ID NO.: 220) | GSAPGPGGGAVNLVRGGTA ATSGSETPGT | RSC-0091 (SEQ ID NO.: 465) | GTAEAASASGGPGGGAVNLVRGGTA PGSP |
| RSN-0092 (SEQ ID NO.: 221) | GSAPGSEGGALNLVRGGAI ATSGSETPGT | RSC-0092 (SEQ ID NO.: 466) | GTAEAASASGGSEGGALNLVRGGAI PGSP |
| RSN-0093 (SEQ ID NO.: 222) | GSAPGTPGGASNLVRGGGA ATSGSETPGT | RSC-0093 (SEQ ID NO.: 467) | GTAEAASASGGTPGGASNLVRGGGA PGSP |
| RSN-0094 (SEQ ID NO.: 223) | GSAPGASGGATNLVRGGEI ATSGSETPGT | RSC-0094 (SEQ ID NO.: 468) | GTAEAASASGGASGGATNLVRGGEI PGSP |
| RSN-0095 (SEQ ID NO.: 224) | GSAPGGTGGAQNLVRGGPA ATSGSETPGT | RSC-0095 (SEQ ID NO.: 469) | GTAEAASASGGGTGGAQNLVRGGPA PGSP |
| RSN-0096 (SEQ ID NO.: 225) | GSAPGEAGGAENLVRGGSI ATSGSETPGT | RSC-0096 (SEQ ID NO.: 470) | GTAEAASASGGEAGGAENLVRGGSI PGSP |
| RSN-1517 (SEQ ID NO.: 226) | GSAPEAGRSANHEPLGLVA TATSGSETPGT | RSC-1517 (SEQ ID NO.: 471) | GTAEAASASGEAGRSANHEPLGLVA TPGSP |
| BSRS-A1 (SEQ ID NO.: 227) | GSAPASGRSTNAGPSGLAG PATSGSETPGT | BSRS-A1 (SEQ ID NO.: 472) | GTAEAASASGASGRSTNAGPSGLAG PPGSP |
| BSRS-A2 (SEQ ID NO.: 228) | GSAPASGRSTNAGPQGLAG QATSGSETPGT | BSRS-A2 (SEQ ID NO.: 473) | GTAEAASASGASGRSTNAGPQGLAG QPGSP |
| BSRS-A3 (SEQ ID NO.: 229) | GSAPASGRSTNAGPPGLTG PATSGSETPGT | BSRS-A3 (SEQ ID NO.: 474) | GTAEAASASGASGRSTNAGPPGLTG PPGSP |
| VP-1 (SEQ ID NO.: 230) | GSAPASSRGTNAGPAGLTG PATSGSETPGT | VP-1 (SEQ ID NO.: 475) | GTAEAASASGASSRGTNAGPAGLTG PPGSP |

TABLE 2-continued

Release Segment Sequences

| Name | Amino Acid Sequence | Name | Amino Acid Sequence |
|---|---|---|---|
| RSN-1752 (SEQ ID NO.: 231) | GSAPASSRTTNTGPSTLTG PATSGSETPGT | RSC-1752 (SEQ ID NO.: 476) | GTAEAASASGASSRTTNTGPSTLTG PPGSP |
| RSN-1512 (SEQ ID NO.: 232) | GSAPAAGRSDNGTPLELVA PATSGSETPGT | RSC-1512 (SEQ ID NO.: 477) | GTAEAASASGAAGRSDNGTPLELVA PPGSP |
| RSN-1517 (SEQ ID NO.: 226) | GSAPEAGRSANHEPLGLVA TATSGSETPGT | RSC-1517 (SEQ ID NO.: 471) | GTAEAASASGEAGRSANHEPLGLVA TPGSP |
| VP-2 (SEQ ID NO.: 233) | GSAPASGRGTNAGPAGLTG PATSGSETPGT | VP-2 (SEQ ID NO.: 478) | GTAEAASASGASGRGTNAGPAGLTG PPGSP |
| RSN-1018 (SEQ ID NO.: 234) | GSAPLFGRNDNHEPLELGG GATSGSETPGT | RSC-1018 (SEQ ID NO.: 479) | GTAEAASASGLFGRNDNHEPLELGG GPGSP |
| RSN-1053 (SEQ ID NO.: 235) | GSAPTAGRSDNLEPLGLVF GATSGSETPGT | RSC-1053 (SEQ ID NO.: 480) | GTAEAASASGTAGRSDNLEPLGLVF GPGSP |
| RSN-1059 (SEQ ID NO.: 236) | GSAPLDGRSDNFHPPELVA GATSGSETPGT | RSC-1059 (SEQ ID NO.: 481) | GTAEAASASGLDGRSDNFHPPELVA GPGSP |
| RSN-1065 (SEQ ID NO.: 237) | GSAPLEGRSDNEEPENLVA GATSGSETPGT | RSC-1065 (SEQ ID NO.: 482) | GTAEAASASGLEGRSDNEEPENLVA GPGSP |
| RSN-1167 (SEQ ID NO.: 238) | GSAPLKGRSDNNAPLALVA GATSGSETPGT | RSC-1167 (SEQ ID NO.: 483) | GTAEAASASGLKGRSDNNAPLALVA GPGSP |
| RSN-1201 (SEQ ID NO.: 239) | GSAPVYSRGTNAGPHGLTG RATSGSETPGT | RSC-1201 (SEQ ID NO.: 484) | GTAEAASASGVYSRGTNAGPHGLTG RPGSP |
| RSN-1218 (SEQ ID NO.: 240) | GSAPANSRGTNKGFAGLIG PATSGSETPGT | RSC-1218 (SEQ ID NO.: 485) | GTAEAASASGANSRGTNKGFAGLIG PPGSP |
| RSN-1226 (SEQ ID NO.: 241) | GSAPASSRLTNEAPAGLTI PATSGSETPGT | RSC-1226 (SEQ ID NO.: 486) | GTAEAASASGASSRLTNEAPAGLTI PPGSP |
| RSN-1254 (SEQ ID NO.: 242) | GSAPDQSRGTNAGPEGLTD PATSGSETPGT | RSC-1254 (SEQ ID NO.: 487) | GTAEAASASGDQSRGTNAGPEGLTD PPGSP |
| RSN-1256 (SEQ ID NO.: 243) | GSAPESSRGTNIGQGGLTG PATSGSETPGT | RSC-1256 (SEQ ID NO.: 488) | GTAEAASASGESSRGTNIGQGGLTG PPGSP |
| RSN-1261 (SEQ ID NO.: 244) | GSAPSSSRGTNQDPAGLTI PATSGSETPGT | RSC-1261 (SEQ ID NO.: 489) | GTAEAASASGSSSRGTNQDPAGLTI PPGSP |
| RSN-1293 (SEQ ID NO.: 245) | GSAPASSRGQNHSPMGLTG PATSGSETPGT | RSC-1293 (SEQ ID NO.: 490) | GTAEAASASGASSRGQNHSPMGLTG PPGSP |
| RSN-1309 (SEQ ID NO.: 246) | GSAPAYSRGPNAGPAGLEG RATSGSETPGT | RSC-1309 (SEQ ID NO.: 491) | GTAEAASASGAYSRGPNAGPAGLEG RPGSP |
| RSN-1326 (SEQ ID NO.: 247) | GSAPASERGNNAGPANLTG FATSGSETPGT | RSC-1326 (SEQ ID NO.: 492) | GTAEAASASGASERGNNAGPANLTG FPGSP |
| RSN-1345 (SEQ ID NO.: 248) | GSAPASHRGTNPKPAILTG PATSGSETPGT | RSC-1345 (SEQ ID NO.: 493) | GTAEAASASGASHRGTNPKPAILTG PPGSP |

TABLE 2-continued

Release Segment Sequences

| Name | Amino Acid Sequence | Name | Amino Acid Sequence |
| --- | --- | --- | --- |
| RSN-1354 (SEQ ID NO.: 249) | GSAPMSSRRTNANPAQLTG PATSGSETPGT | RSC-1354 (SEQ ID NO.: 494) | GTAEAASASGMSSRRTNANPAQLTG PPGSP |
| RSN-1426 (SEQ ID NO.: 250) | GSAPGAGRTDNHEPLELGA AATSGSETPGT | RSC-1426 (SEQ ID NO.: 495) | GTAEAASASGGAGRTDNHEPLELGA APGSP |
| RSN-1478 (SEQ ID NO.: 251) | GSAPLAGRSENTAPLELTA GATSGSETPGT | RSC-1478 (SEQ ID NO.: 496) | GTAEAASASGLAGRSENTAPLELTA GPGSP |
| RSN-1479 (SEQ ID NO.: 252) | GSAPLEGRPDNHEPLALVA SATSGSETPGT | RSC-1479 (SEQ ID NO.: 497) | GTAEAASASGLEGRPDNHEPLALVA SPGSP |
| RSN-1496 (SEQ ID NO.: 253) | GSAPLSGRSDNEEPLALPA GATSGSETPGT | RSC-1496 (SEQ ID NO.: 498) | GTAEAASASGLSGRSDNEEPLALPA GPGSP |
| RSN-1508 (SEQ ID NO.: 254) | GSAPEAGRTDNHEPLELSA PATSGSETPGT | RSC-1508 (SEQ ID NO.: 499) | GTAEAASASGEAGRTDNHEPLELSA PPGSP |
| RSN-1513 (SEQ ID NO.: 255) | GSAPEGGRSDNHGPLELVS GATSGSETPGT | RSC-1513 (SEQ ID NO.: 500) | GTAEAASASGEGGRSDNHGPLELVS GPGSP |
| RSN-1516 (SEQ ID NO.: 256) | GSAPLSGRSDNEAPLELEA GATSGSETPGT | RSC-1516 (SEQ ID NO.: 501) | GTAEAASASGLSGRSDNEAPLELEA GPGSP |
| RSN-1524 (SEQ ID NO.: 257) | GSAPLGGRADNHEPPELGA GATSGSETPGT | RSC-1524 (SEQ ID NO.: 502) | GTAEAASASGLGGRADNHEPPELGA GPGSP |
| RSN-1622 (SEQ ID NO.: 258) | GSAPPPSRGTNAEPAGLTG EATSGSETPGT | RSC-1622 (SEQ ID NO.: 503) | GTAEAASASGPPSRGTNAEPAGLTG EPGSP |
| RSN-1629 (SEQ ID NO.: 259) | GSAPASTRGENAGPAGLEA PATSGSETPGT | RSC-1629 (SEQ ID NO.: 504) | GTAEAASASGASTRGENAGPAGLEA PPGSP |
| RSN-1664 (SEQ ID NO.: 260) | GSAPESSRGTNGAPEGLTG PATSGSETPGT | RSC-1664 (SEQ ID NO.: 505) | GTAEAASASGESSRGTNGAPEGLTG PPGSP |
| RSN-1667 (SEQ ID NO.: 261) | GSAPASSRATNESPAGLTG EATSGSETPGT | RSC-1667 (SEQ ID NO.: 506) | GTAEAASASGASSRATNESPAGLTG EPGSP |
| RSN-1709 (SEQ ID NO.: 262) | GSAPASSRGENPPPGGLTG PATSGSETPGT | RSC-1709 (SEQ ID NO.: 507) | GTAEAASASGASSRGENPPPGGLTG PPGSP |
| RSN-1712 (SEQ ID NO.: 263) | GSAPAASRGTNTGPAELTG SATSGSETPGT | RSC-1712 (SEQ ID NO.: 508) | GTAEAASASGAASRGTNTGPAELTG SPGSP |
| RSN-1727 (SEQ ID NO.: 264) | GSAPAGSRTTNAGPGGLEG PATSGSETPGT | RSC-1727 (SEQ ID NO.: 509) | GTAEAASASGAGSRTTNAGPGGLEG PPGSP |
| RSN-1754 (SEQ ID NO.: 265) | GSAPAPSRGENAGPATLTG AATSGSETPGT | RSC-1754 (SEQ ID NO.: 510) | GTAEAASASGAPSRGENAGPATLTG APGSP |
| RSN-1819 (SEQ ID NO.: 266) | GSAPESGRAANTGPPTLTA PATSGSETPGT | RSC-1819 (SEQ ID NO.: 511) | GTAEAASASGESGRAANTGPPTLTA PPGSP |
| RSN-1832 (SEQ ID NO.: 267) | GSAPNPGRAANEGPPGLPG SATSGSETPGT | RSC-1832 (SEQ ID NO.: 512) | GTAEAASASGNPGRAANEGPPGLPG SPGSP |

TABLE 2-continued

Release Segment Sequences

| Name | Amino Acid Sequence | Name | Amino Acid Sequence |
|---|---|---|---|
| RSN-1855 (SEQ ID NO.: 268) | GSAPESSRAANLTPPELTG PATSGSETPGT | RSC-1855 (SEQ ID NO.: 513) | GTAEAASASGESSRAANLTPPELTG PPGSP |
| RSN-1911 (SEQ ID NO.: 269) | GSAPASGRAANETPPGLTG AATSGSETPGT | RSC-1911 (SEQ ID NO.: 514) | GTAEAASASGASGRAANETPPGLTG APGSP |
| RSN-1929 (SEQ ID NO.: 270) | GSAPNSGRGENLGAPGLTG TATSGSETPGT | RSC-1929 (SEQ ID NO.: 515) | GTAEAASASGNSGRGENLGAPGLTG TPGSP |
| RSN-1951 (SEQ ID NO.: 271) | GSAPTTGRAANLTPAGLTG PATSGSETPGT | RSC-1951 (SEQ ID NO.: 516) | GTAEAASASGTTGRAANLTPAGLTG PPGSP |
| RSN-2295 (SEQ ID NO.: 272) | GSAPEAGRSANHTPAGLTG PATSGSETPGT | RSC-2295 (SEQ ID NO.: 517) | GTAEAASASGEAGRSANHTPAGLTG PPGSP |
| RSN-2298 (SEQ ID NO.: 273) | GSAPESGRAANTTPAGLTG PATSGSETPGT | RSC-2298 (SEQ ID NO.: 518) | GTAEAASASGESGRAANTTPAGLTG PPGSP |
| RSN-2038 (SEQ ID NO.: 274) | GSAPTTGRATEAANLTPAG LTGPATSGSETPGT | RSC-2038 (SEQ ID NO.: 519) | GTAEAASASGTTGRATEAANLTPAG LTGPPGSP |
| RSN-2072 (SEQ ID NO.: 275) | GSAPTTGRAEEAANLTPAG LTGPATSGSETPGT | RSC-2072 (SEQ ID NO.: 520) | GTAEAASASGTTGRAEEAANLTPAG LTGPPGSP |
| RSN-2089 (SEQ ID NO.: 276) | GSAPTTGRAGEAANLTPAG LTGPATSGSETPGT | RSC-2089 (SEQ ID NO.: 521) | GTAEAASASGTTGRAGEAANLTPAG LTGPPGSP |
| RSN-2302 (SEQ ID NO.: 277) | GSAPTTGRATEAANATPAG LTGPATSGSETPGT | RSC-2302 (SEQ ID NO.: 522) | GTAEAASASGTTGRATEAANATPAG LTGPPGSP |
| RSN-3047 (SEQ ID NO.: 278) | GSAPTTGRAGEAEGATSAG ATGPATSGSETPGT | RSC-3047 (SEQ ID NO.: 523) | GTAEAASASGTTGRAGEAEGATSAG ATGPPGSP |
| RSN-3052 (SEQ ID NO.: 279) | GSAPTTGEAGEAANATSAG ATGPATSGSETPGT | RSC-3052 (SEQ ID NO.: 524) | GTAEAASASGTTGEAGEAANATSAG ATGPPGSP |
| RSN-3043 (SEQ ID NO.: 280) | GSAPTTGEAGEAAGLTPAG LTGPATSGSETPGT | RSC-3043 (SEQ ID NO.: 525) | GTAEAASASGTTGEAGEAAGLTPAG LTGPPGSP |
| RSN-3041 (SEQ ID NO.: 281) | GSAPTTGAAGEAANATPAG LTGPATSGSETPGT | RSC-3041 (SEQ ID NO.: 526) | GTAEAASASGTTGAAGEAANATPAG LTGPPGSP |
| RSN-3044 (SEQ ID NO.: 282) | GSAPTTGRAGEAAGLTPAG LTGPATSGSETPGT | RSC-3044 (SEQ ID NO.: 527) | GTAEAASASGTTGRAGEAAGLTPAG LTGPPGSP |
| RSN-3057 (SEQ ID NO.: 283) | GSAPTTGRAGEAANATSAG ATGPATSGSETPGT | RSC-3057 (SEQ ID NO.: 528) | GTAEAASASGTTGRAGEAANATSAG ATGPPGSP |
| RSN-3058 (SEQ ID NO.: 284) | GSAPTTGEAGEAAGATSAG ATGPATSGSETPGT | RSC-3058 (SEQ ID NO.: 529) | GTAEAASASGTTGEAGEAAGATSAG ATGPPGSP |
| RSN-2485 (SEQ ID NO.: 285) | GSAPESGRAANTEPPELGA GATSGSETPGT | RSC-2485 (SEQ ID NO.: 530) | GTAEAASASGESGRAANTEPPELGA GPGSP |
| RSN-2486 (SEQ ID NO.: 286) | GSAPESGRAANTAPEGLTG PATSGSETPGT | RSC-2486 (SEQ ID NO.: 531) | GTAEAASASGESGRAANTAPEGLTG PPGSP |

TABLE 2-continued

Release Segment Sequences

| Name | Amino Acid Sequence | Name | Amino Acid Sequence |
|---|---|---|---|
| RSN-2488 (SEQ ID NO.: 287) | GSAPEPGRAANHEPSGLTE GATSGSETPGT | RSC-2488 (SEQ ID NO.: 532) | GTAEAASASGEPGRAANHEPSGLTE GPGSP |
| RSN-2599 (SEQ ID NO.: 288) | GSAPESGRAANHTGAPPGG LTGPATSGSETPGT | RSC-2599 (SEQ ID NO.: 533) | GTAEAASASGESGRAANHTGAPPGG LTGPPGSP |
| RSN-2706 (SEQ ID NO.: 289) | GSAPTTGRTGEGANATPGG LTGPATSGSETPGT | RSC-2706 (SEQ ID NO.: 534) | GTAEAASASGTTGRTGEGANATPGG LTGPPGSP |
| RSN-2707 (SEQ ID NO.: 290) | GSAPRTGRSGEAANETPEG LEGPATSGSETPGT | RSC-2707 (SEQ ID NO.: 535) | GTAEAASASGRTGRSGEAANETPEG LEGPPGSP |
| RSN-2708 (SEQ ID NO.: 291) | GSAPRTGRTGESANETPAG LGGPATSGSETPGT | RSC-2708 (SEQ ID NO.: 536) | GTAEAASASGRTGRTGESANETPAG LGGPPGSP |
| RSN-2709 (SEQ ID NO.: 292) | GSAPSTGRTGEPANETPAG LSGPATSGSETPGT | RSC-2709 (SEQ ID NO.: 537) | GTAEAASASGSTGRTGEPANETPAG LSGPPGSP |
| RSN-2710 (SEQ ID NO.: 293) | GSAPTTGRAGEPANATPTG LSGPATSGSETPGT | RSC-2710 (SEQ ID NO.: 538) | GTAEAASASGTTGRAGEPANATPTG LSGPPGSP |
| RSN-2711 (SEQ ID NO.: 294) | GSAPRTGRPGEGANATPTG LPGPATSGSETPGT | RSC-2711 (SEQ ID NO.: 539) | GTAEAASASGRTGRPGEGANATPTG LPGPPGSP |
| RSN-2712 (SEQ ID NO.: 295) | GSAPRTGRGGEAANATPSG LGGPATSGSETPGT | RSC-2712 (SEQ ID NO.: 540) | GTAEAASASGRTGRGGEAANATPSG LGGPPGSP |
| RSN-2713 (SEQ ID NO.: 296) | GSAPSTGRSGESANATPGG LGGPATSGSETPGT | RSC-2713 (SEQ ID NO.: 541) | GTAEAASASGSTGRSGESANATPGG LGGPPGSP |
| RSN-2714 (SEQ ID NO.: 297) | GSAPRTGRTGEEANATPAG LPGPATSGSETPGT | RSC-2714 (SEQ ID NO.: 542) | GTAEAASASGRTGRTGEEANATPAG LPGPPGSP |
| RSN-2715 (SEQ ID NO.: 298) | GSAPATGRPGEPANTTPEG LEGPATSGSETPGT | RSC-2715 (SEQ ID NO.: 543) | GTAEAASASGATGRPGEPANTTPEG LEGPPGSP |
| RSN-2716 (SEQ ID NO.: 299) | GSAPSTGRSGEPANATPGG LTGPATSGSETPGT | RSC-2716 (SEQ ID NO.: 544) | GTAEAASASGSTGRSGEPANATPGG LTGPPGSP |
| RSN-2717 (SEQ ID NO.: 300) | GSAPPTGRGGEGANTTPTG LPGPATSGSETPGT | RSC-2717 (SEQ ID NO.: 545) | GTAEAASASGPTGRGGEGANTTPTG LPGPPGSP |
| RSN-2718 (SEQ ID NO.: 301) | GSAPPTGRSGEGANATPSG LTGPATSGSETPGT | RSC-2718 (SEQ ID NO.: 546) | GTAEAASASGPTGRSGEGANATPSG LTGPPGSP |
| RSN-2719 (SEQ ID NO.: 302) | GSAPTTGRASEGANSTPAP LTEPATSGSETPGT | RSC-2719 (SEQ ID NO.: 547) | GTAEAASASGTTGRASEGANSTPAP LTEPPGSP |
| RSN-2720 (SEQ ID NO.: 303) | GSAPTYGRAAEAANTTPAG LTAPATSGSETPGT | RSC-2720 (SEQ ID NO.: 548) | GTAEAASASGTYGRAAEAANTTPAG LTAPPGSP |
| RSN-2721 (SEQ ID NO.: 304) | GSAPTTGRATEGANATPAE LTEPATSGSETPGT | RSC-2721 (SEQ ID NO.: 549) | GTAEAASASGTTGRATEGANATPAE LTEPPGSP |
| RSN-2722 (SEQ ID NO.: 305) | GSAPTVGRASEEANTTPAS LTGPATSGSETPGT | RSC-2722 (SEQ ID NO.: 550) | GTAEAASASGTVGRASEEANTTPAS LTGPPGSP |

TABLE 2-continued

Release Segment Sequences

| Name | Amino Acid Sequence | Name | Amino Acid Sequence |
|---|---|---|---|
| RSN-2723 (SEQ ID NO.: 306) | GSAPTTGRAPEAANATPAPLTGPATSGSETPGT | RSC-2723 (SEQ ID NO.: 551) | GTAEAASASGTTGRAPEAANATPAPLTGPPGSP |
| RSN-2724 (SEQ ID NO.: 307) | GSAPTWGRATEPANATPAPLTSPATSGSETPGT | RSC-2724 (SEQ ID NO.: 552) | GTAEAASASGTWGRATEPANATPAPLTSPPGSP |
| RSN-2725 (SEQ ID NO.: 308) | GSAPTVGRASESANATPAELTSPATSGSETPGT | RSC-2725 (SEQ ID NO.: 553) | GTAEAASASGTVGRASESANATPAELTSPPGSP |
| RSN-2726 (SEQ ID NO.: 309) | GSAPTVGRAPEGANSTPAGLTGPATSGSETPGT | RSC-2726 (SEQ ID NO.: 554) | GTAEAASASGTVGRAPEGANSTPAGLTGPPGSP |
| RSN-2727 (SEQ ID NO.: 310) | GSAPTWGRATEAPNLEPATLTTPATSGSETPGT | RSC-2727 (SEQ ID NO.: 555) | GTAEAASASGTWGRATEAPNLEPATLTTPPGSP |
| RSN-2728 (SEQ ID NO.: 311) | GSAPTTGRATEAPNLTPAPLTEPATSGSETPGT | RSC-2728 (SEQ ID NO.: 556) | GTAEAASASGTTGRATEAPNLTPAPLTEPPGSP |
| RSN-2729 (SEQ ID NO.: 312) | GSAPTQGRATEAPNLSPAALTSPATSGSETPGT | RSC-2729 (SEQ ID NO.: 557) | GTAEAASASGTQGRATEAPNLSPAALTSPPGSP |
| RSN-2730 (SEQ ID NO.: 313) | GSAPTQGRAAEAPNLTPATLTAPATSGSETPGT | RSC-2730 (SEQ ID NO.: 558) | GTAEAASASGTQGRAAEAPNLTPATLTAPPGSP |
| RSN-2731 (SEQ ID NO.: 314) | GSAPTSGRAPEATNLAPAPLTGPATSGSETPGT | RSC-2731 (SEQ ID NO.: 559) | GTAEAASASGTSGRAPEATNLAPAPLTGPPGSP |
| RSN-2732 (SEQ ID NO.: 315) | GSAPTQGRAAEAANLTPAGLTEPATSGSETPGT | RSC-2732 (SEQ ID NO.: 560) | GTAEAASASGTQGRAAEAANLTPAGLTEPPGSP |
| RSN-2733 (SEQ ID NO.: 316) | GSAPTTGRAGSAPNLPPTGLTTPATSGSETPGT | RSC-2733 (SEQ ID NO.: 561) | GTAEAASASGTTGRAGSAPNLPPTGLTTPPGSP |
| RSN-2734 (SEQ ID NO.: 317) | GSAPTTGRAGGAENLPPEGLTAPATSGSETPGT | RSC-2734 (SEQ ID NO.: 562) | GTAEAASASGTTGRAGGAENLPPEGLTAPPGSP |
| RSN-2735 (SEQ ID NO.: 318) | GSAPTTSRAGTATNLTPEGLTAPATSGSETPGT | RSC-2735 (SEQ ID NO.: 563) | GTAEAASASGTTSRAGTATNLTPEGLTAPPGSP |
| RSN-2736 (SEQ ID NO.: 319) | GSAPTTGRAGTATNLPPSGLTTPATSGSETPGT | RSC-2736 (SEQ ID NO.: 564) | GTAEAASASGTTGRAGTATNLPPSGLTTPPGSP |
| RSN-2737 (SEQ ID NO.: 320) | GSAPTTARAGEAENLSPSGLTAPATSGSETPGT | RSC-2737 (SEQ ID NO.: 565) | GTAEAASASGTTARAGEAENLSPSGLTAPPGSP |
| RSN-2738 (SEQ ID NO.: 321) | GSAPTTGRAGGAGNLAPGGLTEPATSGSETPGT | RSC-2738 (SEQ ID NO.: 566) | GTAEAASASGTTGRAGGAGNLAPGGLTEPPGSP |
| RSN-2739 (SEQ ID NO.: 322) | GSAPTTGRAGTATNLPPEGLTGPATSGSETPGT | RSC-2739 (SEQ ID NO.: 567) | GTAEAASASGTTGRAGTATNLPPEGLTGPPGSP |
| RSN-2740 (SEQ ID NO.: 323) | GSAPTTGRAGGAANLAPTGLTEPATSGSETPGT | RSC-2740 (SEQ ID NO.: 568) | GTAEAASASGTTGRAGGAANLAPTGLTEPPGSP |
| RSN-2741 (SEQ ID NO.: 324) | GSAPTTGRAGTAENLAPSGLTTPATSGSETPGT | RSC-2741 (SEQ ID NO.: 569) | GTAEAASASGTTGRAGTAENLAPSGLTTPPGSP |

TABLE 2-continued

Release Segment Sequences

| Name | Amino Acid Sequence | Name | Amino Acid Sequence |
|---|---|---|---|
| RSN-2742 (SEQ ID NO.: 325) | GSAPTTGRAGSATNLGPGG LTGPATSGSETPGT | RSC-2742 (SEQ ID NO.: 570) | GTAEAASASGTTGRAGSATNLGPGG LTGPPGSP |
| RSN-2743 (SEQ ID NO.: 326) | GSAPTTARAGGAENLTPAG LTEPATSGSETPGT | RSC-2743 (SEQ ID NO.: 571) | GTAEAASASGTTARAGGAENLTPAG LTEPPGSP |
| RSN-2744 (SEQ ID NO.: 327) | GSAPTTARAGSAENLSPSG LTGPATSGSETPGT | RSC-2744 (SEQ ID NO.: 572) | GTAEAASASGTTARAGSAENLSPSG LTGPPGSP |
| RSN-2745 (SEQ ID NO.: 328) | GSAPTTARAGGAGNLAPEG LTTPATSGSETPGT | RSC-2745 (SEQ ID NO.: 573) | GTAEAASASGTTARAGGAGNLAPEG LTTPPGSP |
| RSN-2746 (SEQ ID NO.: 329) | GSAPTTSRAGAAENLTPTG LTGPATSGSETPGT | RSC-2746 (SEQ ID NO.: 574) | GTAEAASASGTTSRAGAAENLTPTG LTGPPGSP |
| RSN-2747 (SEQ ID NO.: 330) | GSAPTYGRTTTPGNEPPAS LEAEATSGSETPGT | RSC-2747 (SEQ ID NO.: 575) | GTAEAASASGTYGRTTTPGNEPPAS LEAEPGSP |
| RSN-2748 (SEQ ID NO.: 331) | GSAPTYSRGESGPNEPPPG LTGPATSGSETPGT | RSC-2748 (SEQ ID NO.: 576) | GTAEAASASGTYSRGESGPNEPPPG LTGPPGSP |
| RSN-2749 (SEQ ID NO.: 332) | GSAPAWGRTGASENETPAP LGGEATSGSETPGT | RSC-2749 (SEQ ID NO.: 577) | GTAEAASASGAWGRTGASENETPAP LGGEPGSP |
| RSN-2750 (SEQ ID NO.: 333) | GSAPRWGRAETTPNTPPEG LETEATSGSETPGT | RSC-2750 (SEQ ID NO.: 578) | GTAEAASASGRWGRAETTPNTPPEG LETEPGSP |
| RSN-2751 (SEQ ID NO.: 334) | GSAPESGRAANHTGAEPPE LGAGATSGSETPGT | RSC-2751 (SEQ ID NO.: 579) | GTAEAASASGESGRAANHTGAEPPE LGAGPGSP |
| RSN-2754 (SEQ ID NO.: 335) | GSAPTTGRAGEAANLTPAG LTESATSGSETPGT | RSC-2754 (SEQ ID NO.: 580) | GTAEAASASGTTGRAGEAANLTPAG LTESPGSP |
| RSN-2755 (SEQ ID NO.: 336) | GSAPTTGRAGEAANLTPAA LTESATSGSETPGT | RSC-2755 (SEQ ID NO.: 581) | GTAEAASASGTTGRAGEAANLTPAA LTESPGSP |
| RSN-2756 (SEQ ID NO.: 337) | GSAPTTGRAGEAANLTPAP LTESATSGSETPGT | RSC-2756 (SEQ ID NO.: 582) | GTAEAASASGTTGRAGEAANLTPAP LTESPGSP |
| RSN-2757 (SEQ ID NO.: 338) | GSAPTTGRAGEAANLTPEP LTESATSGSETPGT | RSC-2757 (SEQ ID NO.: 583) | GTAEAASASGTTGRAGEAANLTPEP LTESPGSP |
| RSN-2758 (SEQ ID NO.: 339) | GSAPTTGRAGEAANLTPAG LTGAATSGSETPGT | RSC-2758 (SEQ ID NO.: 584) | GTAEAASASGTTGRAGEAANLTPAG LTGAPGSP |
| RSN-2759 (SEQ ID NO.: 340) | GSAPTTGRAGEAANLTPEG LTGAATSGSETPGT | RSC-2759 (SEQ ID NO.: 585) | GTAEAASASGTTGRAGEAANLTPEG LTGAPGSP |
| RSN-2760 (SEQ ID NO.: 341) | GSAPTTGRAGEAANLTPEP LTGAATSGSETPGT | RSC-2760 (SEQ ID NO.: 586) | GTAEAASASGTTGRAGEAANLTPEP LTGAPGSP |
| RSN-2761 (SEQ ID NO.: 342) | GSAPTTGRAGEAANLTPAG LTEAATSGSETPGT | RSC-2761 (SEQ ID NO.: 587) | GTAEAASASGTTGRAGEAANLTPAG LTEAPGSP |
| RSN-2762 (SEQ ID NO.: 343) | GSAPTTGRAGEAANLTPEG LTEAATSGSETPGT | RSC-2762 (SEQ ID NO.: 588) | GTAEAASASGTTGRAGEAANLTPEG LTEAPGSP |

TABLE 2-continued

Release Segment Sequences

| Name | Amino Acid Sequence | Name | Amino Acid Sequence |
|---|---|---|---|
| RSN-2763 (SEQ ID NO.: 344) | GSAPTTGRAGEAANLTPAP LTEAATSGSETPGT | RSC-2763 (SEQ ID NO.: 589) | GTAEAASASGTTGRAGEAANLTPAP LTEAPGSP |
| RSN-2764 (SEQ ID NO.: 345) | GSAPTTGRAGEAANLTPEP LTEAATSGSETPGT | RSC-2764 (SEQ ID NO.: 590) | GTAEAASASGTTGRAGEAANLTPEP LTEAPGSP |
| RSN-2765 (SEQ ID NO.: 346) | GSAPTTGRAGEAANLTPEP LTGPATSGSETPGT | RSC-2765 (SEQ ID NO.: 591) | GTAEAASASGTTGRAGEAANLTPEP LTGPPGSP |
| RSN-2766 (SEQ ID NO.: 347) | GSAPTTGRAGEAANLTPAG LTGGATSGSETPGT | RSC-2766 (SEQ ID NO.: 592) | GTAEAASASGTTGRAGEAANLTPAG LTGGPGSP |
| RSN-2767 (SEQ ID NO.: 348) | GSAPTTGRAGEAANLTPEG LTGGATSGSETPGT | RSC-2767 (SEQ ID NO.: 593) | GTAEAASASGTTGRAGEAANLTPEG LTGGPGSP |
| RSN-2768 (SEQ ID NO.: 349) | GSAPTTGRAGEAANLTPEA LTGGATSGSETPGT | RSC-2768 (SEQ ID NO.: 594) | GTAEAASASGTTGRAGEAANLTPEA LTGGPGSP |
| RSN-2769 (SEQ ID NO.: 350) | GSAPTTGRAGEAANLTPEP LTGGATSGSETPGT | RSC-2769 (SEQ ID NO.: 595) | GTAEAASASGTTGRAGEAANLTPEP LTGGPGSP |
| RSN-2770 (SEQ ID NO.: 351) | GSAPTTGRAGEAANLTPAG LTEGATSGSETPGT | RSC-2770 (SEQ ID NO.: 596) | GTAEAASASGTTGRAGEAANLTPAG LTEGPGSP |
| RSN-2771 (SEQ ID NO.: 352) | GSAPTTGRAGEAANLTPEG LTEGATSGSETPGT | RSC-2771 (SEQ ID NO.: 597) | GTAEAASASGTTGRAGEAANLTPEG LTEGPGSP |
| RSN-2772 (SEQ ID NO.: 353) | GSAPTTGRAGEAANLTPAP LTEGATSGSETPGT | RSC-2772 (SEQ ID NO.: 598) | GTAEAASASGTTGRAGEAANLTPAP LTEGPGSP |
| RSN-2773 (SEQ ID NO.: 354) | GSAPTTGRAGEAANLTPEP LTEGATSGSETPGT | RSC-2773 (SEQ ID NO.: 599) | GTAEAASASGTTGRAGEAANLTPEP LTEGPGSP |
| RSN-3047 (SEQ ID NO.: 278) | GSAPTTGRAGEAEGATSAG ATGPATSGSETPGT | RSC-3047 (SEQ ID NO.: 523) | GTAEAASASGTTGRAGEAEGATSAG ATGPPGSP |
| RSN-2783 (SEQ ID NO.: 355) | GSAPEAGRSAEATSAGATG PATSGSETPGT | RSC-2783 (SEQ ID NO.: 600) | GTAEAASASGEAGRSAEATSAGATG PPGSP |
| RSN-3107 (SEQ ID NO.: 356) | GSAPSASGTYSRGESGPGS PATSGSETPGT | RSC-3107 (SEQ ID NO.: 601) | GTAEAASASGSASGTYSRGESGPGS PPGSP |
| RSN-3103 (SEQ ID NO.: 357) | GSAPSASGEAGRTDTHPGS PATSGSETPGT | RSC-3103 (SEQ ID NO.: 602) | GTAEAASASGSASGEAGRTDTHPGS PPGSP |
| RSN-3102 (SEQ ID NO.: 358) | GSAPSASGEPGRAAEHPGS PATSGSETPGT | RSC-3102 (SEQ ID NO.: 603) | GTAEAASASGSASGEPGRAAEHPGS PPGSP |
| RSN-3119 (SEQ ID NO.: 359) | GSAPSPAGESSRGTTIAGS PATSGSETPGT | RSC-3119 (SEQ ID NO.: 604) | GTAEAASASGSPAGESSRGTTIAGS PPGSP |
| RSN-3043 (SEQ ID NO.: 280) | GSAPTTGEAGEAAGLTPAG LTGPATSGSETPGT | RSC-3043 (SEQ ID NO.: 525) | GTAEAASASGTTGEAGEAAGLTPAG LTGPPGSP |
| RSN-2789 (SEQ ID NO.: 360) | GSAPEAGESAGATPAGLTG PATSGSETPGT | RSC-2789 (SEQ ID NO.: 605) | GTAEAASASGEAGESAGATPAGLTG PPGSP |

TABLE 2-continued

Release Segment Sequences

| Name | Amino Acid Sequence | Name | Amino Acid Sequence |
|---|---|---|---|
| RSN-3109 (SEQ ID NO.: 361) | GSAPSASGAPLELEAGPGS PATSGSETPGT | RSC-3109 (SEQ ID NO.: 606) | GTAEAASASGSASGAPLELEAGPGS PPGSP |
| RSN-3110 (SEQ ID NO.: 362) | GSAPSASGEPPELGAGPGS PATSGSETPGT | RSC-3110 (SEQ ID NO.: 607) | GTAEAASASGSASGEPPELGAGPGS PPGSP |
| RSN-3111 (SEQ ID NO.: 363) | GSAPSASGEPSGLTEGPGS PATSGSETPGT | RSC-3111 (SEQ ID NO.: 608) | GTAEAASASGSASGEPSGLTEGPGS PPGSP |
| RSN-3112 (SEQ ID NO.: 364) | GSAPSASGTPAPLTEPPGS PATSGSETPGT | RSC-3112 (SEQ ID NO.: 609) | GTAEAASASGSASGTPAPLTEPPGS PPGSP |
| RSN-3113 (SEQ ID NO.: 365) | GSAPSASGTPAELTEPPGS PATSGSETPGT | RSC-3113 (SEQ ID NO.: 610) | GTAEAASASGSASGTPAELTEPPGS PPGSP |
| RSN-3114 (SEQ ID NO.: 366) | GSAPSASGPPPGLTGPPGS PATSGSETPGT | RSC-3114 (SEQ ID NO.: 611) | GTAEAASASGSASGPPPGLTGPPGS PPGSP |
| RSN-3115 (SEQ ID NO.: 367) | GSAPSASGTPAPLGGEPGS PATSGSETPGT | RSC-3115 (SEQ ID NO.: 612) | GTAEAASASGSASGTPAPLGGEPGS PPGSP |
| RSN-3125 (SEQ ID NO.: 368) | GSAPSPAGAPEGLTGPAGS PATSGSETPGT | RSC-3125 (SEQ ID NO.: 613) | GTAEAASASGSPAGAPEGLTGPAGS PPGSP |
| RSN-3126 (SEQ ID NO.: 369) | GSAPSPAGPPEGLETEAGS PATSGSETPGT | RSC-3126 (SEQ ID NO.: 614) | GTAEAASASGSPAGPPEGLETEAGS PPGSP |
| RSN-3127 (SEQ ID NO.: 370) | GSAPSPTSGQGGLTGPGSE PATSGSETPGT | RSC-3127 (SEQ ID NO.: 615) | GTAEAASASGSPTSGQGGLTGPGSE PPGSP |
| RSN-3131 (SEQ ID NO.: 371) | GSAPSESAPPEGLETESTE PATSGSETPGT | RSC-3131 (SEQ ID NO.: 616) | GTAEAASASGSESAPPEGLETESTE PPGSP |
| RSN-3132 (SEQ ID NO.: 372) | GSAPSEGSEPLELGAASET PATSGSETPGT | RSC-3132 (SEQ ID NO.: 617) | GTAEAASASGSEGSEPLELGAASET PPGSP |
| RSN-3133 (SEQ ID NO.: 373) | GSAPSEGSGPAGLEAPSET PATSGSETPGT | RSC-3133 (SEQ ID NO.: 618) | GTAEAASASGSEGSGPAGLEAPSET PPGSP |
| RSN-3138 (SEQ ID NO.: 374) | GSAPSEPTPPASLEAEPGS PATSGSETPGT | RSC-3138 (SEQ ID NO.: 619) | GTAEAASASGSEPTPPASLEAEPGS PPGSP |

In another aspect, the RS for incorporation into the subject recombinant polypeptides can be designed to be selectively sensitive in order to have different rates of cleavage and different cleavage efficiencies to the various proteases for which they are substrates. As a given protease may be found in different concentrations in diseased tissues, including but not limited to a tumor, a blood cancer, or an inflammatory tissue or site of inflammation, compared to healthy tissues or in the circulation, the disclosure provides RS that have had the individual amino acid sequences engineered to have a higher or lower cleavage efficiency for a given protease in order to ensure that the recombinant polypeptide is preferentially converted from the prodrug form to the active form (i.e., by the separation and release of the binding moieties and XTEN from the recombinant polypeptide after cleavage of the RS) when in proximity to the target cell or tissue and its co-localized proteases compared to the rate of cleavage of the RS in healthy tissue or the circulation such that the released antibody fragment binding moieties have a greater ability to bind to ligands in the diseased tissues compared to the prodrug form that remains in circulation. By such selective designs, the therapeutic index of the resulting compositions can be improved, resulting in reduced side effects relative to convention therapeutics that do not incorporate such site-specific activation.

As used herein cleavage efficiency is defined as the log 2 value of the ratio of the percentage of the test substrate comprising the RS cleaved to the percentage of the control substrate AC1611 cleaved when each is subjected to the protease enzyme in biochemical assays (further detailed in the Examples) in which reaction in conducted wherein the initial substrate concentration is 6 μM, the reactions are incubated at 37° C. for 2 hours before being stopped by adding EDTA, with the amount of digestion products and uncleaved substrate analyzed by non-reducing SDS-PAGE to establish the ratio of the percentage cleaved. The cleavage efficiency is calculated as follows:

$$Log_2\left(\frac{\% \text{ Cleaved for substrate of interest}}{\% \text{ cleaved for } AC1611 \text{ in the same experiment}}\right)$$

Thus, a cleavage efficiency of −1 means that the amount of test substrate cleaved was 50% compared to that of the control substrate, while a cleavage efficiency of +1 means that the amount of test substrate cleaved was 200% compared to that of the control substrate. A higher rate of cleavage by the test protease relative to the control would result in a higher cleavage efficiency, and a slower rate of cleavage by the test protease relative to the control would result in a lower cleavage efficiency. As detailed in the Examples, a control RS sequence AC1611 (RSR-1517), having the amino acid sequence EAGRSANHEPLGLVAT (SEQ ID NO.: 1), was established as having an appropriate baseline cleavage efficiency by the proteases legumain, MMP-2, MMP-7, MMP-9, MMP-14, uPA, and matriptase, when tested in in vitro biochemical assays for rates of cleavage by the individual proteases. By selective substitution of amino acids at individual locations in the RS peptides, libraries of RS were created and evaluated against the panel of the 7 proteases (detailed more fully in the Examples), resulting in profiles that were used to establish guidelines for appropriate amino acid substitutions in order to achieve RS with desired cleavage efficiencies. In making RS with desired cleavage efficiencies, substitutions using the hydrophilic amino acids A, E, G, P, S, and T are preferred, however other L-amino acids can be substituted at given positions in order to adjust the cleavage efficiency so long as the RS retains at least some susceptibility to cleavage by a protease. Conservative substitutions of amino acids in a peptide to retain or effect activity is well within the knowledge and capabilities of a person within skill in the art. In one embodiment, the disclosure provides RS in which the RS is cleaved by a protease selected from legumain, MMP-1, MMP-2, MMP-7, MMP-9, MMP-11, MMP-14, uPA, or matriptase with at least a 0.2 $\log_2$, or 0.4 $\log_2$, or 0.8 $\log_2$, or 1.0 $\log_2$ higher cleavage efficiency in an in vitro biochemical competitive assay compared to the cleavage by the same protease of a control sequence RSR-1517 having the sequence EAGRSANHEPLGLVAT (SEQ ID NO.: 1). In another embodiment, the disclosure provides RS in which the RS is cleaved by a protease selected from legumain, MMP-1, MMP-2, MMP-7, MMP-9, MMP-11, MMP-14, uPA, or matriptase with at least a 0.2 $\log_2$, or 0.4 $\log_2$, or 0.8 $\log_2$, or 1.0 $\log_2$ lower cleavage efficiency in an in vitro biochemical competitive assay compared to the cleavage by the same protease of a control sequence RSR-1517 having the sequence EAGRSANHEPLGLVAT (SEQ ID NO.: 1). In one embodiment, the disclosure provides RS in which the rate of cleavage of the RS by a protease selected from legumain, MMP-1, MMP-2, MMP-7, MMP-9, MMP-11, MMP-14, uPA, or matriptase is at least 2-fold, or at least 4-fold, or at least 8 fold, or at least 16-fold faster compared to the control sequence RSR-1517 having the sequence EAGRSANHEPLGLVAT (SEQ ID NO.: 1). In another embodiment, the disclosure provides RS in which the rate of cleavage of the RS by a protease selected from legumain, MMP-1, MMP-2, MMP-7, MMP-9, MMP-11, MMP-14, uPA, or matriptase is at least 2-fold, or at least 4-fold, or at least 8 fold, or at least 16-fold slower compared to the control sequence RSR-1517 having the sequence EAGRSANHEPLGLVAT (SEQ ID NO.: 1).

In another aspect, the disclosure provides AAC comprising multiple RS wherein each RS sequence is selected from the group of sequences set forth in Table 1 and the RS are linked to each other by 1 to 6 amino acids selected from glycine, serine, alanine, and threonine. In one embodiment, the AAC comprises a first RS and a second RS different from the first RS wherein each RS sequence is selected from the group of sequences set forth in Table 1 and the RS are linked to each other by 1 to 6 amino acids selected from glycine, serine, alanine, and threonine. In another embodiment, the AAC comprises a first RS, a second RS different from the first RS, and a third RS different from the first and the second RS wherein each sequence is selected from the group of sequences set forth in Table 1 and the first and the second and the third RS are linked to each other by 1 to 6 amino acids selected from glycine, serine, alanine, and threonine. It is specifically intended that the multiple RS of the AAC can be concatenated to form a sequence that can be cleaved by multiple proteases at different rates or efficiency of cleavage. In another embodiment, the disclosure provides AAC comprising an RS1 and an RS2 selected from the group of sequences set forth in Tables 1 and 2 and an XTEN 1 and XTEN 2 selected from the group of sequences set forth in Tables 8 and 10 wherein the RS1 is fused between the XTEN1 and the binding moieties and the RS2 is fused between the XTEN2 and the binding moieties. It is contemplated that such compositions would be more readily cleaved by diseased target tissues that express multiple proteases, compared with healthy tissues or when in the normal circulation, with the result that the resulting fragments bearing the binding moieties would more readily penetrate the target tissue; e.g., a tumor, and have an enhanced ability to bind and link the target cell and the effector cell (or just the target cell in the case of AAC designed with a single binding moiety.

TABLE 3

Proteases of Target Tissues.

| Class of Proteases | Protease |
|---|---|
| Metalloproteinases | Meprin |
| | Neprilysin (CD10) |
| | PSMA |
| | BMP-1 |
| | A disintegrin and metalloproteinases (ADAMs) |
| | ADAM8 |
| | ADAM9 |
| | ADAM10 |
| | ADAM12 |
| | ADAM15 |
| | ADAM17 (TACE) |
| | ADAM19 |
| | ADAM28 (MDC-L) |
| | ADAM with thrombospondin motifs (ADAMTS) |
| | ADAMTS1 |
| | ADAMTS4 |
| | ADAMTS5 |
| | Matrix Metalloproteinases (MMPs) |
| | MMP-1 (Collagenase 1) |
| | MMP-2 (Gelatinase A) |
| | MMP-3 (ml) |
| | MMP-7 (Matrilysin 1) |
| | MMP-8 (Collagenase 2) |

TABLE 3-continued

Proteases of Target Tissues.

| Class of Proteases | Protease |
|---|---|
| | MMP-9 (Gelatinase B) |
| | MMP-10 (Stromelysin 2) |
| | MMP-11(Stromelysin 3) |
| | MMP-12 (Macrophage elastase) |
| | MMP-13 (Collagenase 3) |
| | MMP-14 (MT1-MMP) |
| | MMP-15 (MT2-MMP) |
| | MMP-19 |
| | MMP-23 (CA-MMP) |
| | MMP-24 (MT5-MMP) |
| | MMP-26 (Matrilysin 2) |
| | MMP-27 (CMMP) |
| Cysteine Proteases | Legumain |
| | Cysteine cathepsins |
| | Cathepsin B |
| | Cathepsin C |
| | Cathepsin K |
| | Cathepsin L |
| | Cathepsin S |
| | Cathespin X |
| Aspartate Proteases | Cathepsin D |
| | Cathepsin E |
| | Secretase |
| Serine Proteases | Urokinase (uPA) |
| | Tissue-type plasminogen activator (tPA) |
| | Plasmin |
| | Thrombin |
| | Prostate-specific antigen (PSA, KLK3) |
| | Human neutrophil elastase (HNE) |
| | Elastase |
| | Tryptase |
| | Type II transmembrane serine proteases (TTSPs) |
| | DESC1 |
| | Hepsin (HPN) |
| | Matriptase |
| | Matriptase-2 |
| | TMPRSS2 |
| | TMPRSS3 |
| | TMPRSS4 (CAP2) |
| | Fibroblast Activation Protein (FAP) |
| | kallikrein-related peptidase (KLK family) |
| | KLK4 |
| | KLK5 |
| | KLK6 |
| | KLK7 |
| | KLK8 |
| | KLK10 |
| | KLK11 |
| | KLK13 |
| | KLK14 |

The RS of the disclosure are useful for inclusion in recombinant polypeptides as therapeutics for treatment of cancers, autoimmune diseases, inflammatory diseases and other conditions where localized activation of the recombinant polypeptide is desirable. The subject compositions address an unmet need and are superior in one or more aspects including enhanced terminal half-life, targeted delivery, and improved therapeutic ratio with reduced toxicity to healthy tissues compared to conventional antibody therapeutics or bispecific antibody therapeutics that are active upon injection.

IV. Binding Moieties

In another aspect, the disclosure provides recombinant polypeptides comprising a first binding moiety (FBM) having specific binding affinity to a ligand. In one embodiment, the binding moiety is selected from an antibody, a cytokine, an interleukin, a chemokine, or a fragment thereof. In another embodiment, the binding moiety is a cell receptor or a fragment thereof. In another embodiment, the binding moiety is an antibody fragment having binding affinity to a cell receptor or target cell marker.

In some embodiments, the disclosure provides recombinant polypeptides that are AAC comprising a first binding moiety (FBM) and a second binding moiety (SBM), each having specific binding affinity to a their respective ligands. In some embodiments, the AAC comprise a first and a second binding moiety, each of which are antibody fragments. In such compositions, a binding moiety directed against a target cell marker of a disease tissue is used in combination with a second binding moiety directed towards an effector cell marker; thus it is bifunctional. As used herein, the antibody fragment is an antibody fragment containing an antigen binding domain that is capable of binding, especially specific binding, to a target ligand of interest. In such embodiments, the antibody fragment can be, but is not limited to, variable or hypervariable regions of light and/or heavy chains of an antibody (VL, VH), variable fragments (Fv), Fab' fragments, F(ab')2 fragments, Fab fragments, single chain antibodies (scAb), single chain variable fragment (scFv), linear antibodies, a single domain antibody, complementarity determining regions (CDR), domain antibodies (dAbs), single domain heavy chain immunoglobulins of the BHH or BNAR type, single domain light chain immunoglobulins, or other polypeptides known in the art containing an antibody fragment capable of binding target proteins or epitopes on target proteins associated with a target or effector cell. The VL and VH of the antibody fragments can also be configured in a single chain diabody configuration. In one embodiment, the first of the two binding moieties of the polypeptide contains an antibody fragment targeted to an effector cell ligand (such as, but not limited to CD3, CD16, TCRa, TCRp, CD28 and the like) and the second binding moiety contains an antibody fragment that has a disease targeting domain (e.g., a target cell marker produced by a disease tissue or cell).

The origin of the antibody fragments contemplated by the disclosure can be derived from a naturally occurring antibody or fragment thereof, a non-naturally occurring antibody or fragment thereof, a humanized antibody or fragment thereof, a synthetic antibody or fragment thereof, a hybrid antibody or fragment thereof, or an engineered antibody or fragment thereof. Methods for generating an antibody for a given target marker are well known in the art. For example, the monoclonal antibodies may be made using the hybridoma method first described by Kohler et al., Nature, 256:495 (1975), or may be made by recombinant DNA methods (U.S. Pat. No. 4,816,567). The structure of antibodies and fragments thereof, variable regions of heavy and light chains of an antibody (VH and VL), single chain variable regions (scFv), complementarity determining regions (CDR), and domain antibodies (dAbs) are well understood. Methods for generating a polypeptide having a desired antigen-binding moiety of a target cell marker are known in the art.

Therapeutic monoclonal antibodies from which VL and VH and CDR domains can be derived for the subject compositions are known in the art. Such therapeutic antibodies include, but are not limited to, rituximab, IDEC/Genentech/Roche (see, e.g., U.S. Pat. No. 5,736,137), a chimeric anti-CD20 antibody used in the treatment of many lymphomas, leukemias, and some autoimmune disorders; ofatumumab, an anti-CD20 antibody approved for use for chronic lymphocytic leukemia, and under development for follicular non-Hodgkin's lymphoma, diffuse large B cell lymphoma, rheumatoid arthritis and relapsing remitting multiple sclerosis, being developed by GlaxoSmithKline; lucatumumab (HCD122), an anti-CD40 antibody developed by Novartis for Non-Hodgkin's or Hodgkin's Lymphoma (see, for example, U.S. Pat. No. 6,899,879), AME-133, an antibody developed by Applied Molecular Evolution which binds to cells expressing CD20 to treat non-Hodgkin's lymphoma, veltuzumab (hA20), an antibody developed by Immunomedics, Inc. which binds to cells expressing CD20 to treat immune thrombocytopenic purpura, HumaLYM developed by Intracel for the treatment of low-grade B-cell lymphoma, and ocrelizumab, developed by Genentech which is an anti-CD20 monoclonal antibody for treatment of rheumatoid arthritis (see, e.g., U.S. Patent Application 20090155257), trastuzumab (see, e.g., U.S. Pat. No. 5,677,171), a humanized anti-HER2/neu antibody approved to treat breast cancer developed by Genentech; pertuzumab, an anti-HER2 dimerization inhibitor antibody developed by Genentech in treatment of in prostate, breast, and ovarian cancers; (see, e.g., U.S. Pat. No. 4,753,894); cetuximab, an anti-EGFR antibody used to treat epidermal growth factor receptor (EGFR)-expressing, KRAS wild-type metastatic colorectal cancer and head and neck cancer, developed by Imclone and BMS (see U.S. Pat. No. 4,943,533; PCT WO 96/40210); panitumumab, a fully human monoclonal antibody specific to the epidermal growth factor receptor (also known as EGF receptor, EGFR, ErbB-1 and HER1, currently marketed by Amgen for treatment of metastatic colorectal cancer (see U.S. Pat. No. 6,235,883); zalutumumab, a fully human IgG1 monoclonal antibody developed by Genmab that is directed towards the epidermal growth factor receptor (EGFR) for the treatment of squamous cell carcinoma of the head and neck (see, e.g., U.S. Pat. No. 7,247,301); nimotuzumab, a chimeric antibody to EGFR developed by Biocon, YM Biosciences, Cuba, and Oncosciences, Europe) in the treatment of squamous cell carcinomas of the head and neck, nasopharyngeal cancer and glioma (see, e.g., U.S. Pat. Nos. 5,891,996; 6,506,883); matuzumab, a humanized monoclonal that is directed towards the epidermal growth factor receptor (EGFR) that was developed by Takeda Pharmaceutical for the treatment of colorectal, lung, esophageal and stomach cancer (see, e.g., U.S. Patent Application 20090175858A1); cetuximab, a chimeric (mouse/human) monoclonal antibody that is directed to epidermal growth factor receptor (EGFR) used for the treatment of metastatic colorectal cancer, metastatic non-small cell lung cancer and head and neck cancer that was developed by Bristol-Myers Squibb and Merck KGaA (see, e.g., U.S. Pat. No. 6,217,866); alemtuzumab, a humanized monoclonal antibody to CD52 marketed by Bayer Schering Pharma for the treatment of chronic lymphocytic leukemia (CLL), cutaneous T-cell lymphoma (CTCL) and T-cell lymphoma; muromonab-CD3, an anti-CD3 antibody developed by Ortho Biotech/Johnson & Johnson used as an immunosuppressant biologic given to reduce acute rejection in patients with organ transplants; ibritumomab tiuxetan, an anti-CD20 monoclonal antibody developed by IDEC/Schering AG as treatment for some forms of B cell non-Hodgkin's lymphoma; gemtuzumab ozogamicin, an anti-CD33 (p67 protein) antibody linked to a cytotoxic chelator tiuxetan, to which a radioactive isotope is attached, developed by Celltech/Wyeth used to treat acute myelogenous leukemia; ABX-CBL, an anti-CD147 antibody developed by Abgenix; ABX-IL8, an anti-IL8 antibody developed by Abgenix, ABX-MA1, an anti-MUC18 antibody developed by Abgenix, Pemtumomab (R1549, 90Y-muHMFG1), an anti-MUC1 in development by Antisoma, Therex (R1550), an anti-MUC1 antibody developed by Antisoma, AngioMab (AS1405), developed by Antisoma, HuBC-1, developed by Antisoma, Thioplatin (AS1407) developed by Antisoma, ANTEGREN (natalizumab), an anti-alpha-4-beta-1 (VLA4) and alpha-4-beta-7 antibody developed by Biogen, VLA-1 mAb, an anti-VLA-1 integrin antibody developed by Biogen, LTBR mAb, an anti-lymphotoxin beta receptor (LTBR) antibody developed by Biogen, CAT-152, an anti-TGF-β2 antibody developed by Cambridge Antibody Technology, J695, an anti-IL-12 antibody developed by Cambridge Antibody Technology and Abbott, CAT-192, an anti-TGFβ1 antibody developed by Cambridge Antibody Technology and Genzyme, CAT-213, an anti-Eotaxin1 antibody developed by Cambridge Antibody Technology, LYMPHOSTAT-B, an anti-Blys antibody developed by Cambridge Antibody Technology and Human Genome Sciences Inc., TRAIL-R1mAb, an anti-TRAIL-R1 antibody developed by Cambridge Antibody Technology and Human Genome Sciences, Inc.; Herceptin, an anti-HER receptor family antibody developed by Genentech; Anti-Tissue Factor (ATF), an anti-Tissue Factor antibody developed by Genentech; Xolair (Omalizumab), an anti-IgE antibody developed by Genentech, MLN-02 Antibody (formerly LDP-02), developed by Genentech and Millennium Pharmaceuticals; HuMax CD4®, an anti-CD4 antibody developed by Genmab; tocilizuma, and anti-IL6R antibody developed by Chugai; HuMax-IL15, an anti-IL15 antibody developed by Genmab and Amgen, HuMax-Inflam, developed by Genmab and Medarex; HuMax-Cancer, an anti-Heparanase I antibody developed by Genmab and Medarex and Oxford GlycoSciences; HuMax-Lymphoma, developed by Genmab and Amgen, HuMax-TAC, developed by Genmab; IDEC-131, an anti-CD40L antibody developed by IDEC Pharmaceuticals; IDEC-151 (Clenoliximab), an anti-CD4 antibody developed by IDEC Pharmaceuticals; IDEC-114, an anti-CD80 antibody developed by IDEC Pharmaceuticals; IDEC-152, an anti-CD23 developed by IDEC Pharmaceuticals; an anti-KDR antibody developed by Imclone, DC101, an anti-flk-1 antibody developed by Imclone; anti-VE cadherin antibodies developed by Imclone; CEA-CIDE (labetuzumab), an anti-carcinoembryonic antigen (CEA) antibody developed by Immunomedics; Yervoy (ipilimumab), an anti-CTLA4 antibody developed by Bristol-Myers Squibb in the treatment of melanoma; Lumphocide® (Epratuzumab), an anti-CD22 antibody developed by Immunomedics, AFP-Cide, developed by Immunomedics; MyelomaCide, developed by Immunomedics; LkoCide, developed by Immunomedics; ProstaCide, developed by Immunomedics; MDX-010, an anti-CTLA4 antibody developed by Medarex; MDX-060, an anti-CD30 antibody developed by Medarex; MDX-070 developed by Medarex; MDX-018 developed by Medarex; OSIDEM (IDM-1), an anti-HER2 antibody developed by Medarex and Immuno-Designed Molecules; HuMax®-CD4, an anti-CD4 antibody developed by Medarex and Genmab; HuMax-IL15, an anti-IL15 antibody developed by Medarex and Genmab; anti-intercellular adhesion molecule-1 (ICAM-1) (CD54) antibodies developed by MorphoSys, MOR201; tremelimumab, an anti-CTLA-4 antibody developed by Pfizer; visilizumab, an anti-CD3 antibody developed by Protein Design Labs; Anti-a 5β1 Integrin, developed by Protein Design Labs; anti-IL-12, developed by Protein Design Labs; ING-1, an anti-Ep-CAM antibody developed by Xoma; and MLN01, an anti-Beta2 integrin antibody developed by Xoma; all of the above-cited antibody references in this paragraph are expressly incorporated herein by reference. The sequences for the above antibodies can be obtained from publicly available databases, patents, or literature references. In addition, non-limiting examples of monoclonal antibodies and VH and VL sequences (and, in some cases, with indicated CDR sequences) from anti-CD3 antibodies are presented in Table 4 and non-limiting examples of monoclonal antibodies and VH and VL sequences (and, in some cases, with indicated CDR sequences) to cancer, tumor, or target cell markers are presented in Table 5.

In certain instances, the complementary determining regions of the heavy chain and/or the light chain for the antibody fragment directed to the effector cells to be incorporated into the subject AAC compositions are derived from known anti-CD3 antibodies, such as, for example, muromonab-CD3 (OKT3), otelixizumab (TRX4), teplizumab (MGA031), visilizumab (Nuvion), SP-34 or I2C, TR-66 or X35-3, VIT3, BMA030 (BW264/56), CLB-T3/3, CRIS7, YTH12.5, Fl 11-409, CLB-T3.4.2, TR-66, WT32, SPv-T3b, 11D8, XIII-141, XIII-46, XIII-87, 12F6, T3/RW2-8C8, T3/RW2-4B6, OKT3D, M-T301, SMC2, F101.01, UCHT-1 and WT-31. In some embodiments, the effector cell binding moiety of the subject AAC is a single chain antibody fragment comprising a paired VL and VH sequence as set forth in Table 4. In the foregoing embodiment, the VL and VH are linked by long linkers of hydrophilic amino acids selected from the sequences set forth in Table 6 and the scFv are linked together by a short linker of hydrophilic amino acids selected from the group of sequences set forth in Table 7. In one embodiment, the long linker used to link the VL and VH is L7 of Table 6 and the intermolecular linker that fuses the two scFv is S-1 or S-2 of Table 7. In another embodiment, the disclosure provides AAC compositions comprising a single chain diabody in which after folding, the first domain (VL or VH) is paired with the last domain (VH or VL) to form one scFv and the two domains in the middle are paired to form the other scFv in which the first and second domains, as well as the third and last domains, are fused together by a short linker of hydrophilic amino acids selected from the sequences set forth in Table 7 and the second and the third variable domains are fused by a long linker selected from Table 6. As will be appreciated by one of skill in the art, the selection of the short linker and long linker is to prevent the incorrect pairing of adjacent variable domains, thereby facilitating the formation of the single chain diabody configuration comprising the VL and VH of the first binding moiety and the second binding moiety.

TABLE 4

Anti-CD3 Monoclonal Antibodies and Sequences

| Clone name | Antibody name | Target | VH Sequence | VL Sequence |
|---|---|---|---|---|
| HuOKT3 | | CD3 | QVQLVQSGGGVVQPGRSLRL SCKASGYTFTRYTMHWVRQA PGKGLEWIGYINPSRGYTNY NQKVKDRFTISRDNSKNTAF LQMDSLRPEDTGVYFCARYY DDHYCLDYWGQGTPVTVSS (SEQ ID NO.: 620) | DIQMTQSPSSLSASVGDR VTITCSASSSVSYMNWYQ QTPGKAPKRWIYDTSKLA SGVPSRFSGSGSGTDYTF TISSLQPEDIATYYCQQW SSNPFTFGQGTKLQITR (SEQ ID NO.: 630) |
| HuUCHT1 | | CD3 | EVQLVESGGGLVQPGGSLRL SCAASGYSFTGYTMNWVRQA PGKGLEWVALINPYKGVSTY NQKFKDRFTISVDKSKNTAY LQMNSLRAEDTAVYYCARSG YYGDSDWYFDVWGQGTLVTV SS (SEQ ID NO.: 621) | DIQMTQSPSSLSASVGDR VTITCRASQDIRNYLNWY QQKPGKAPKLLIYYTSRL ESGVPSRFSGSGSGTDYT LTISSLQPEDFATYYCQQ GNTLPWTFGQGTKVEIK (SEQ ID NO.: 631) |
| Hu12F6 | | CD3 | QVQLVQSGGGVVQPGRSLRL SCKASGYTFTSYTMHWVRQA PGKGLEWIGYINPSSGYTKY NQKFKDRFTISADKSKSTAF LQMDSLRPEDTGVYFCARWQ DYDVYFDYWGQGTPVTVSS (SEQ ID NO.: 622) | DIQMTQSPSSLSASVGDR VTMTCRASSSVSYMHWYQ QTPGKAPKPWIYATSNLA SGVPSRFSGSGSGTDYTL TISSLQPEDIATYYCQQW SSNPPTFGQGTKLQITR (SEQ ID NO.: 632) |
| MOKT3 | | CD3 | QVQLQQSGAELARPGASVKM SCKASGYTFTRYTMHWVKQR PGQGLEWIGYINPSRGYTNY NQKFKDKATLTTDKSSSTAY MQLSSLTSEDSAVYYCARYY DDHYCLDYWGQGTTLTVSS (SEQ ID NO.: 623) | QIVLTQSPAIMSASPGEK VTMTCSASSSVSYMNWYQ QKSGTSPKRWIYDTSKLA SGVPAHFRGSGSGTSYSL TISGMEAEDAATYYCQQW SSNPFTFGSGTKLEINR (SEQ ID NO.: 633) |
| MT103 | blinatumomab | CD3 | DIKLQQSGAELARPGASVKM SCKTSGYTFTRYTMHWVKQR PGQGLEWIGYINPSRGYTNY NQKFKDKATLTTDKSSSTAY MQLSSLTSEDSAVYYCARYY DDHYCLDYWGQGTTLTVSS (SEQ ID NO.: 624) | DIQLTQSPAIMSASPGEK VTMTCRASSSVSYMNWYQ QKSGTSPKRWIYDTSKVA SGVPYRFSGSGSGTSYSL TISSMEAEDAATYYCQQW SSNPLTFGAGTKLELK (SEQ ID NO.: 634) |
| MT110 | solitomab | CD3 | DVQLVQSGAEVKKPGASVKV SCKASGYTFTRYTMHWVRQA PGQGLEWIGYINPSRGYTNY ADSVKGRFTITTDKSTSTAY | DIVLTQSPATLSLSPGER ATLSCRASQSVSYMNWYQ QKPGKAPKRWIYDTSKVA SGVPARFSGSGSGTDYSL |

TABLE 4-continued

Anti-CD3 Monoclonal Antibodies and Sequences

| Clone name | Antibody name | Target | VH Sequence | VL Sequence |
|---|---|---|---|---|
| | | | MELSSLRSEDTATYYCARYY DDHYCLDYWGQGTTVTVSS (SEQ ID NO.: 625) | TINSLEAEDAATYYCQQW SSNPLTFGGGTKVEIK (SEQ ID NO.: 635) |
| CD3.7 | | CD3 | EVQLVESGGGLVQPGGSL KLSCAASGFTFNKYAMNW VRQAPGKGLEWVARIRSK YNNYATYYADSVKDRFTI SRDDSKNTAYLQMNNLKT EDTAVYYCVRHGNFGNSY ISYWAYWGQGTLVTVSS (SEQ ID NO.: 626) | QTVVTQEPSLTVSPGGT VTLTCGSSTGAVTSGYY PNWVQQKPGQAPRGLIG GTKFLAPGTPARFSGSL LGGKAALTLSGVQPEDE AEYYCALWYSNRWVFGG GTKLTVL (SEQ ID NO.: 636) |
| CD3.8 | | CD3 | EVQLVESGGGLVQPGGSL RLSCAASGFTFNTYAMNW VRQAPGKGLEWVGRIRSK YNNYATYYADSVKGRFTI SRDDSKNTLYLQMNSLRA EDTAVYYCVRHGNFGNSY VSWFAYWGQGTLVTVSS (SEQ ID NO.: 627) | QAVVTQEPSLTVSPGGT VTLTCGSSTGAVTTSNY ANWVQQKPGQAPRGLIG GTNKRAPGVPARFSGSL LGGKAALTLSGAQPEDE AEYYCALWYSNLWVFGG GTKLTVL (SEQ ID NO.: 637) |
| CD3.9 | | CD3 | EVQLLESGGGLVQPGGSL KLSCAASGFTFNTYAMNW VRQAPGKGLEWVARIRSK YNNYATYYADSVKDRFTI SRDDSKNTAYLQMNNLKT EDTAVYYCVRHGNFGNSY VSWFAYWGQGTLVTVSS (SEQ ID NO.: 628) | ELVVTQEPSLTVSPGGT VTLTCRSSTGAVTTSNY ANWVQQKPGQAPRGLIG GTNKRAPGTPARFSGSL LGGKAALTLSGVQPEDE AEYYCALWYSNLWVFGG GTKLTVL (SEQ ID NO.: 638) |
| CD3.10 | | CD3 | EVKLLESGGGLVQPKGSL KLSCAASGFTFNTYAMNW VRQAPGKGLEWVARIRSK YNNYATYYADSVKDRFTI SRDDSQSILYLQMNNLKT EDTAMYYCVRHGNFGNSY VSWFAYWGQGTLVTVSS (SEQ ID NO.: 629) | QAVVTQESALTTSPGET VTLTCRSSTGAVTTSNY ANWVQEKPDHLFTGLIG GTNKRAPGVPARFSGSL IGDKAALTITGAQTEDE AIYFCALWYSNLWVFGG GTKLTVL (SEQ ID NO.: 639) |

* underlined sequences, if present, are CDRs within the VL and VH

TABLE 5

Anti-target Cell Monoclonal Antibodies and Sequences

| Trade Name | Antibody Name | Target Cell Marker | VH Sequence | VL Sequence |
|---|---|---|---|---|
| Tysabri™ | natalizumab | Alpha 4 Integrin | QVQLVQSGAEVKKPGAS VKVSCKASGFNIKDTYI HWVRQAPGQRLEWMGRI DPANGYTKYDPKFQGRV TITADTSASTAYMELSS LRSEDTAVYYCAREGYY GNYGVYAMDYWGQGTLV TVSS (SEQ ID NO.: 640) | DIQMTQSPSSLSASVGD RVTITCKTSQDINKYMA WYQQTPGKAPRLLIHYT SALQPGIPSRFSGSGSG RDYTFTISSLQPEDIAT YYCLQYDNLWTFGQGTK VEIK (SEQ ID NO.: 740) |
| REGN910 | nesvacumab | Ang2 | EVQLVESGGGLVQPGGS LRLSCAASGFTFSSYDI HWVRQATGKGLEWVSAI GPAGDTYYPGSVKGRFT ISRENAKNSLYLQMNSL RAGDTAVYYCARGLITF GGLIAPFDYWGQGTLVT VSS (SEQ ID NO.: 641) | EIVLTQSPGTLSLSPGE RATLSCRASQSVSSTYL AWYQQKPGQAPRLLIYG ASSRATGIPDRFSGSGS GTDFTLTISRLEPEDFA VYYCQHYDNSQTFGQGT KVEIK (SEQ ID NO.: 741) |
| hMFE23 | | CEA | QVKLEQSGAEVVKPGAS VKLSCKASGFNIKDSYM HWLRQGPGQRLEWIGWI DPENGDTEYAPKFQGKA | ENVLTQSPSSMSASVGD RVNIACSASSSVSYMHW FQQKPGKSPKLWIYSTS NLASGVPSRFSGSGSGT |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | | TFTTDTSANTAYLGLSS LRPEDTAVYYCNEGTPT GPYYFDYWGQGTLVTVS S (SEQ ID NO.: 642) | DYSLTISSMQPEDAATY YCQQRSSYPLTFGGGTK LEIK (SEQ ID NO.: 742) |
| M5A (humanized T84.66) | | CEA | EVQLVESGGGLVQPGGS LRLSCAASGFNIKDTYM HWVRQAPGKGLEWVARI DPANGNSKYADSVKGRF TISADTSKNTAYLQMNS LRAEDTAVYYCAPFGYY VSDYAMAYWGQGTLVTV SS (SEQ ID NO.: 643) | DIQLTQSPSSLSASVGD RVTITCRAGESVDIFGV GFLHWYQQKPGKAPKLL IYRASNLESGVPSRFSG SGSRTDFTLTISSLQPE DFATYYCQQTNEDPYTF GQGTKVEIK (SEQ ID NO.: 743) |
| M5B (humanized T84.66) | | CEA | EVQLVESGGGLVQPGGS LRLSCAASGFNIKDTYM HWVRQAPGKGLEWVARI DPANGNSKYVPKFQGRA TISADTSKNTAYLQMNS LRAEDTAVYYCAPFGYY VSDYAMAYWGQGTLVTV SS (SEQ ID NO.: 644) | DIQLTQSPSSLSASVGD RVTITCRAGESVDIFGV GFLHWYQQKPGKAPKLL IYRASNLESGVPSRFSG SGSRTDFTLTISSLQPE DFATYYCQQTNEDPYTF GQGTKVEIK (SEQ ID NO.: 744) |
| CEA-Cide | Labetuzumab (MN-14) | CEACAM5 | EVQLVESGGGVVQPGRS LRLSCSASGFDFTTYWM SWVRQAPGKGLEWIGEI HPDSSTINYAPSLKDRF TISRDNAKNTLFLQMDS LRPEDTGVYFCASLYFG FPWFAYWGQGTPVTVSS (SEQ ID NO.: 645) | DIQLTQSPSSLSASVGD RVTITCKASQDVGTSVA WYQQKPGKAPKLLIYWT STRHTGVPSRFSGSGSG TDFTFTISSLQPEDIAT YYCQQYSLYRSFGQGTK VEIK (SEQ ID NO.: 745) |
| CEA-Scan | arcitumomab | CEACAM5 | EVKLVESGGGLVQPGGS LRLSCATSGFTFTDYYM NWVRQPPGKALEWLGFI GNKANGYTTEYSASVKG RFTISRDKSQSILYLQM NTLRAEDSATYYCTRDR GLRFYFDYWGQGTTLTV SS (SEQ ID NO.: 646) | QTVLSQSPAILSASPGE KVTMTCRASSSVTYIHW YQQKPGSSPKSWIYATS NLASGVPARFSGSGSGT SYSLTISRVEAEDAATY YCQHWSSKPPTFGGGTK LEIKR (SEQ ID NO.: 746) |
| MT110 | | CEACAM5 | EVQLVESGGGLVQPGRS LRLSCAASGFTVSSYWM HWVRQAPGKGLEWVGFI RNKANGGTTETAASVKG RFTISRDDSKNTLYLQM NSLRAEDTAVYYCARDR GLRFYFDYWGQGTVTV SS (SEQ ID NO.: 647) | QAVLTQPASLSASPGAS ASLTCTLRRGINVGAYS IYWYQQKPGSPPQYLLR YKSDSDKQQGSGVSSRF SASKDASANAGILLISG LQSEDEADYYCMIWHSG ASAVFGGGTKLTVL (SEQ ID NO.: 747) |
| MT103 | blinatumomab | CD19 | QVQLQQSGAELVRPGSS VKISCKASGYAFSSYWM NWVKQRPGQGLEWIGQI WPGDGDTNYNGKFKGKA TLTADESSSTAYMQLSS LASEDSAVYFCARRETT TVGRYYYAMDYWGQGTT VTVSS (SEQ ID NO.: 648) | DIQLTQSPASLAVSLGQ RATISCKASQSVDYDGD SYLNWYQQIPGQPPKLL IYDASNLVSGIPPRFSG SGSGTDFTLNIHPVEKV DAATYHCQQSTEDPWTF GGGTKLEIK (SEQ ID NO.: 748) |
| Arzerra | ofatumumab | CD20 | EVQLVESGGGLVQPGRS LRLSCAASGFTFNDYAM HWVRQAPGKGLEWVSTI SWNSGSIGYADSVKGRF TISRDNAKKSLYLQMNS LRAEDTALYYCAKDIQY GNYYYGMDVWGQGTTVT VSS (SEQ ID NO.: 649) | EIVLTQSPATLSLSPGE RATLSCRASQSVSSYLA WYQQKPGQAPRLLIYDA SNRATGIPARFSGSGSG TDFTLTISSLEPEDFAV YYCQQRSNWPITFGQGT RLEIK (SEQ ID NO.: 749) |

TABLE 5-continued

Anti-target Cell Monoclonal Antibodies and Sequences

| Trade Name | Antibody Name | Target Cell Marker | VH Sequence | VL Sequence |
|---|---|---|---|---|
| Bexxar™ | tositumomab | CD20 | QAYLQQSGAELVRPGAS VKMSCKASGYTFTSYNM HWVKQTPRQGLEWIGAI YPGNGDTSYNQKFKGKA TLTVDKSSSTAYMQLSS LTSEDSAVYFCARVVYY SNSYWYFDVWGTGTTVT VSG (SEQ ID NO.: 650) | QIVLSQSPAILSASPGE KVTMTCRASSSVSYMHW YQQKPGSSPKPWIYAPS NLASGVPARFSGSGSGT SYSLTISRVEAEDAATY YCQQWSFNPPTFGAGTK LELK (SEQ ID NO.: 750) |
| GAZYVA | Obinutuzumab | CD20 | EVQLVQSGAEVKKPGSS VKVSCKASGYAFSYSWI NWVRQAPGQGLEWMGRI FPGDGDTDYNGKFKGRV TITADKSTSTAYMELSS LRSEDTAVYYCARNVFD GYWLVYWGQGTLVTVSS (SEQ ID NO.: 651) | DIVMTQTPLSLPVTPGE PASISCRSSKSLLHSNG ITYLYWYLQKPGQSPQL LIYQMSNLVSGVPDRFS GSGSGTDFTLKISRVEA EDVGVYYCAQNLELPYT FGGGTKVEIK (SEQ ID NO.: 751) |
| | Ocrelizumab/ 2H7 v16 | CD20 | EVQLVESGGGLVQPGGS LRLSCAASGYTFTSYNM HWVRQAPGKGLEWVGAI YPGNGDTSYNQKFKGRF TISVDKSKNTLYLQMNS LRAEDTAVYYCARVVYY SNSYWYFDVWGQGTLVT VSS (SEQ ID NO.: 652) | DIQMTQSPSSLSASVGD RVTITCRASSSVSYMHW YQQKPGKAPKLIYAPS NLASGVPSRFSGSGSGT DFTLTISSLQPEDFATY YCQQWSFNPPTFGQGTK VEIK (SEQ ID NO.: 752) |
| Ritiman™ | rituximab | CD20 | QVQLQQPGAELVKPGAS VKMSCKASGYTFTSYNM HWVKQTPGRGLEWIGAI YPGNGDTSYNQKFKGKA TLTADKSSSTAYMQLSS LTSEDSAVYYCARSTYY GGDWYFNVWGAGTTVTV SA (SEQ ID NO.: 653) | QIVLSQSPAILSASPGE KVTMTCRASSSVSYIHW FQQKPGSSPKPWIYATS NLASGVPVRFSGSGSGT SYSLTISRVEAEDAATY YCQQWTSNPPTFGGGTK LEIK (SEQ ID NO.: 753) |
| Zevalin™ | ibritumomab tieuxetan | CD20 | QAYLQQSGAELVRPGAS VKMSCKASGYTFTSYNM HWVKQTPRQGLEWIGAI YPGNGDTSYNQKFKGKA TLTVDKSSSTAYMQLSS LTSEDSAVYFCARVVYY SNSYWYFDVWGTGTTVT VSA (SEQ ID NO.: 654) | QIVLSQSPAILSASPGE KVTMTCRASSSVSYMHW YQQKPGSSPKPWIYAPS NLASGVPARFSGSGSGT SYSLTISRVEAEDAATY YCQQWSFNPPT**FGAGTK LELK (SEQ ID NO.: 754) |
| Mylotarg | Gemtuzumab (hP67.6) | CD33 | QLVQSGAEVKKPGSSVK VSCKASGYTITDSNIHW VRQAPGQSLEWIGYIYP YEGGTDYNQKFKNRATL TVDNPTNTAYMELSSLR SEDTDFYYCVNGNPWLA YWGQGTLVTVSS (SEQ ID NO.: 655) | DIQLTQSPSTLSASVGD RVTITCRASESLDNYGI RFLTWFQQKPGKAPKLL MYAASNQGSGVPSRFSG SGSGTEFTLTISSLQPD DFATYYCQQTKEVPWSF GQGTKVEVK (SEQ ID NO.: 755) |
| Daratumumab | | CD38 | EVQLLESGGGLVQPGGS LRLSCAVSGFTFNSFAM SWVRQAPGKGLEWVSAI SGSGGGTYYADSVKGRF TISRDNSKNTLYLQMNS LRAEDTAVYFCAKDKIL WFGEPVFDYWGQGTLVT VSS (SEQ ID NO.: 656) | EIVLTQSPATLSLSPGE RATLSCRASQSVSSYLA WYQQKPGQAPRLLIYDA SNRATGIPARFSGSGSG TDFTLTISSLEPEDFAV YYCQQRSNWPPTFGQGT KVEIK (SEQ ID NO.: 756) |
| | 1F6 | CD70 | QIQLVQSGPEVKKPGET VKISCKASGYTFTNYGM NWVKQAPGKGLKWMGWI NTYTGEPTYADAFKGRF | DIVLTQSPASLAVSLGQ RATISCRASKSVSTSGY SFMHWYQQKPGQPPKLL IYLASNLESGVPARFSG |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | | AFSLETSASTAYLQINN LKNEDTATYFCARDYGD YGMDYWGQGTSVTVSS (SEQ ID NO.: 657) | SGSGTDFTLNIHPVEEE DAATYYCQHSREVPWTF GGGTKLEIK (SEQ ID NO.: 757) |
| | 2F2 | CD70 | QVQLQQSGTELMTPGAS VTMSCKTSGYTFSTYWI EWVKQRPGHGLEWIGEI LGPSGYTDYNEKFKAKA TFTADTSSNTAYMQLSS LASEDSAVYYCARWDRL YAMDYWGGGTSVTVSS (SEQ ID NO.: 658) | DIVLTQSPASLTVSLGQ KTTISCRASKSVSTSGY SFMHWYQLKPGQSPKLL IYLASDLPSGVPARFSG SGSGTDFTLKIHPVEEE DAATYYCQHSREIPYTF GGGTKLEIT (SEQ ID NO.: 758) |
| | 2H5 | CD70 | QVQLVESGGGVVQPGRS LRLSCAASGFTFSSYIM HWVRQAPGKGLEWVAVI SYDGRNKYYADSVKGRF TISRDNSKNTLYLQMNS LRAEDTAVYYCARDTDG YDFDYWGQGTLVTVSS (SEQ ID NO.: 659) | EIVLTQSPATLSLSPGE RATLSCRASQSVSSYLA WYQQKPGQAPRLLIYDA SNRATGIPARFSGSGSG TDFTLTISSLEPEDFAV YYCQQRTNWPLTFGGGT KVEIK (SEQ ID NO.: 759) |
| | 10B4 | CD70 | QIQLVESGGGVVQPGRS LRLSCAASGFTFGYYAM HWVRQAPGKGLEWVAVI SYDGSIKTYADSVKGRF TISRDNSKNTLYLQMNS LRAEDTAVYYCAREGPY SNYLDYWGQGTLVTVSS (SEQ ID NO.: 660) | AIQLTQSPSSLSASVGD RVTITCRASQGISSALA WYQQKPGKAPKFLIYDA SSLESGVPSRFSGSGSG TDFTLTISSLQPEDFAT YYCQQFESTPFTFGPGT KVDIK (SEQ ID NO.: 760) |
| | 8B5 | CD70 | QVQLVESGGGVVQPGRS LRLSCATSGFTFSDYGM HWVRQAPGKGLEWVAVI WYDGSNKYYADSVKGRF TISRDNSKKTLSLQMNS LRAEDTAVYYCARDSIM VRGDYWGQGTLVTVSS (SEQ ID NO.: 661) | DIQMTQSPSSLSASVGD RVTITCRASQGISSWLA WYQQKPEKAPKSLIYAA SSLQSGVPSRFSGSGSG TDFTLTISSLQPEDFAT YYCQQYNSYPLTFGGGT KVEIK (SEQ ID NO.: 761) |
| | 18E7 | CD70 | QVQLVESGGGVVQPGRS LRLSCAASGFTFSDHGM HWVRQAPGKGLEWVAVI WYDGSNKYYADSVKGRF TISRDNSKNTLYLQMNS LRAEDTAVYYCARDSIM VRGDYWGQGTLVTVSS (SEQ ID NO.: 662) | DIQMTQSPSSLSASVGD RVTITCRASQGISSWLA WYQQKPEKAPKSLIYAA SSLQSGVPSRFSGSGSG TDFTLTISSLQPEDFAT YYCQQYNSYPLTFGGGT KVEIK (SEQ ID NO.: 762) |
| | 69A7 | CD70 | QVQLQESGPGLVKPSET LSLTCTVSGGSVSSDYY YWSWIRQPPGKGLEWLG YIYYSGSTNYNPSLKSR VTISVDTSKNQFSLKLR SVTTADTAVYYCARGDG DYGGNCFDYWGQGTLVT VSS (SEQ ID NO.: 663) | EIVLTQSPATLSLSPGE RATLSCRASQSVSSYLA WYQQKPGQAPRLLIFDA SNRATGIPARFSGSGSG TDFTLTISSLEPEDFAV YYCQQRSNWPLTFGGGT KVEIK (SEQ ID NO.: 763) |
| CE-355621 | | cMET | QVQLVQSGAEVKKPGAS VKVSCKASGYTFTSYGF SWVRQAPGQGLEWMGWI SASNGNTYYAQKLQGRV TMTTDTSTSTAYMELRS LRSDDTAVYYCARVYAD YADYWGQGTLVTVSS (SEQ ID NO.: 664) | DIQMTQSPSSVSASVGD RVTITCRASQGINTWLA WYQQKPGKAPKLLIYAA SSLKSGVPSRFSGSGSG TDFTLTISSLQPEDFAT YYCQQANSFPLTFGGGT KVEIK (SEQ ID NO.: 764) |
| LY2875358 | emibetuzumab | cMET | QVQLVQSGAEVKKPGAS VKVSCKASGYTFTDYYM HWVRQAPGQGLEWMGRV NPNRRGTTYNQKFEGRV TMTTDTSTSTAYMELRS LRSDDTAVYYCARANWL | DIQMTQSPSSLSASVGD RVTITCSVSSSVSSIYL HWYQQKPGKAPKLLIYS TSNLASGVPSRFSGSGS GTDFTLTISSLQPEDFA TYYCQVYSGYPLTFGGG |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | | DYWGQGTTVTVSS (SEQ ID NO.: 665) | TKVEIK (SEQ ID NO.: 765) |
| MetMAb | onartuzumab | cMET | EVQLVESGGGLVQPGGS LRLSCAASGYTFTSYWL HWVRQAPGKGLEWVGMI DPSNSDTRFNPNFKDRF TISADTSKNTAYLQMNS LRAEDTAVYYCATYRSY VTPLDYWGQGTLVTVSS (SEQ ID NO.: 666) | DIQMTQSPSSLSASVGD RVTITCKSSQSLLYTSS QKNYLAWYQQKPGKAPK LLIYWASTRESGVPSRF SGSGSGTDFTLTISSLQ PEDFATYYCQQYYAYPWT FGQGTKVEIK (SEQ ID NO.: 766) |
| | tremelimumab (CP-675206, or 11.2.1) | CTLA4 | QVQLVESGGGVVQPGRS LRLSCAASGFTFSSYGM HWVRQAPGKGLEWVAVI WYDGSNKYYADSVKGRF TISRDNSKNTLYLQMNS LRAEDTAVYYCARDPRG ATLYYYYYGMDVWGQGT TVTVSS (SEQ ID NO.: 667) | DIQMTQSPSSLSASVGD RVTITCRASQSINSYLD WYQQKPGKAPKLLIYAA SSLQSGVPSRFSGSGSG TDFTLTISSLQPEDFAT YYCQQYYSTPFTFGPGT KVEIK (SEQ ID NO.: 767) |
| Yervoy | Ipilimumab 10D1 | CTLA4 | QVQLVESGGGVVQPGRS LRLSCAASGFTFSSYTM HWVRQAPGKGLEWVTFI SYDGNNKYYADSVKGRF TISRDNSKNTLYLQMNS LRAEDTAIYYCARTGWL GPFDYWGQGTLVTVSS (SEQ ID NO.: 668) | EIVLTQSPGTLSLSPGE RATLSCRASQSVGSSYL AWYQQKPGQAPRLLIYG AFSRATGIPDRFSGSGS GTDFTLTISRLEPEDFA VYYCQQYGSSPWTFGQG TKVEIK (SEQ ID NO.: 768) |
| AGS16F | H16-7.8 | ENPP3 | QVQLQESGPGLVKPSQT LSLTCTVSGGSISSGGY YWSWIRQHPGKGLEWIGY IIYYSGSTYYNPSLKSR VTISVDTSKNQFSLKLN SVTAADTAVFYCARVAI VTTIPGGMDVWGQGTTV TVSS (SEQ ID NO.: 669) | EIVLTQSPDFQSVTPKE KVTITCRASQSIGISLH WYQQKPDQSPKLLIKYA SQSFSGVPSRFSGSGSG TDFTLTINSLEAEDAAT YYCHQSRSFPWTFGQGT KVEIK (SEQ ID NO.: 769) |
| MT110 | solitomab | EpCAM | EVQLLEQSGAELVRPGT SVKISCKASGYAFTNYW LGWVKQRPGHGLEWIGD IFPGSGNIHYNEKFKGK ATLTADKSSSTAYMQLS SLTFEDSAVYFCARLRN WDEPMDYWGQGTTVTVS S (SEQ ID NO.: 670) | ELVMTQSPSSLTVTAGE KVTMSCKSSQSLLNSGN QKNYLTWYQQKPGQPPK LLIYWASTRESGVPDRF TGSGSGTDFTLTISSVQ AEDLAVYYCQNDYSYPL TFGAGTKLEIK (SEQ ID NO.: 770) |
| MT201 | Adecatumumab | EpCAM | EVQLLESGGGVVQPGRS LRLSCAASGFTFSSYGM HWVRQAPGKGLEWVAVI SYDGSNKYYADSVKGRF TISRDNSKNTLYLQMNS LRAEDTAVYYCAKDMGW GSGWRPYYYYGMDVWGQ GTTVTVSS (SEQ ID NO.: 671) | ELQMTQSPSSLSASVGD RVTITCRTSQSISSYLN WYQQKPGQPPKLLIYWA STRESGVPDRFSGSGSG TDFTLTISSLQPEDSAT YYCQQSYDIPYTFGQGT KLEIK (SEQ ID NO.: 771) |
| Panorex | Edrecolomab Mab CO17-1A | EpCAM | QVQLQQSGAELVRPGTS VKVSCKASGYAFTNYLI EWVKQRPGQGLEWIGVI NPGSGGTNYNERFRGRA TLTADKSSSTAYMQLSS LTSDDSAVYFCARDGPW FAYWGQGTLVTVSA (SEQ ID NO.: 672) | NIVMTQSPKSMSMSVGE RVTLTCKASENVVTYVS WYQQKPEQSPKLLIYGA SNRYTGVPDRFTGSGSA TDFTLTISSVQAEDLAD YHCGQGYSTPYTFGGGT KLEIK (SEQ ID NO.: 772) |
| | tucotuzumab | EpCAM | QIQLVQSGPELKKPGET VKISCKASGYTFTNYGM NWVRQAPGKGLKWMGWI NTYTGEPTYADDFKGRF VFSLETSASTAFLQLNN | QILLTQSPAIMSASPGE KVTMTCSASSSVSYMLW YQQKPGSSPKPWIFDTS NLASGPARFSGSGSGT SYSLIISSMEAEDAATY |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | | LRSEDTATYFCVRFISK GDYWGQGTSVTVSS (SEQ ID NO.: 673) | YCHQRSGYPYTFGGGTK LEIK (SEQ ID NO.: 773) |
| UBS-54 | | EpCAM | VQLQQSDAELVKPGASV KISCKASGYTFTDHAIH WVKQNPEQGLEWIGYFS PGNDDFKYNERFKGKAT LTADKSSSTAYVQLNSL TSEDSAVYFCTRSLNMA YWGQGTSVTVSS (SEQ ID NO.: 674) | DIVMTQSPDSLAVSLGE RATINCKSSQSVLYSSN NKNYLAWYQQKPGQPPK LLIYWASTRESGVPDRF SGSGSGTDFTLTISSLQ AEDVAVYYCQQYYSYPL TFGGGTKVKES (SEQ ID NO.: 774) |
| 3622W94 | 323/A3 | EpCAM | EVQLVQSGPEVKKPGAS VKVSCKASGYTFTNYGM NWVRQAPGQGLEWMGWI NTYTGEPTYGEDFKGRF AFSLDTSASTAYMELSS LRSEDTAVYFCARFGNY VDYWGQGSLVTVSS (SEQ ID NO.: 675) | DIVMTQSPLSLPVTPGE PASISCRSSINKKGSNG ITYLYWYLQKPGQSPQL LIYQMSNLASGVPDRFS GSGSGTDFTLKISRVEA EDVGVYYCAQNLEIPRT FGQGTKVEIK (SEQ ID NO.: 775) |
| 4D5MOCBv2 | | EpCAM | EVQLVQSGPGLVQPGGS VRISCAASGYTFTNYGM NWVKQAPGKGLEWMGWI NTYTGESTYADSFKGRF TFSLDTSASAAYLQINS LRAEDTAVYYCARFAIK GDYWGQGTLLTVSS (SEQ ID NO.: 676) | DIQMTQSPSSLSASVGD RVTITCRSTKSLLHSNG ITYLYWYQQKPGKAPKL LIYQMSNLASGVPSRFS SSGSGTDFTLTISSLQP EDFATYYCAQNLEIPRT FGQGTKVEIK (SEQ ID NO.: 776) |
| 4D5MOCB | | EpCAM | EVQLVQSGPGLVQPGGS VRISCAASGYTFTNYGM NWVKQAPGKGLEWMGWI NTYTGESTYADSFKGRF TFSLDTSASAAYLQINS LRAEDTAVYYCARFAIK GDYWGQGTLLTVSS (SEQ ID NO.: 677) | DIQMTQSPSSLSASVGD RVTITCRSTKSLLHSNG ITYLYWYQQKPGKAPKL LIYQMSNLASGVPSRFS SSGSGTDFTLTISSLQP EDFATYYCAQNLEIPRT FGQGTKVELK (SEQ ID NO.: 777) |
| MEDI-547 | 1C1 | EphA2 | EVQLLESGGGLVQPGGS LRLSCAASGFTFSHYMM AWVRQAPGKGLEWVSRI GPSGGPTHYADSVKGRF TISRDNSKNTLYLQMNS LRAEDTAVYYCAGYDSG YDYVAVAGPAEYFQHWG QGTLVTVSS (SEQ ID NO.: 678) | DIQMTQSPSSLSASVGD RVTITCRASQSISTWLA WYQQKPGKAPKLLIYKA SNLHTGVPSRFSGSGSG TEFSLTISGLQPDDFAT YYCQQYNSYSRTFGQGT KVEIK (SEQ ID NO.: 778) |
| MORAb-003 | farletuzumab | FOLR1 | EVQLVESGGGVVQPGRS LRLSCSASGFTFSGYGL SWVRQAPGKGLEWVAMI SSGGSYTYYADSVKGRF AISRDNAKNTLFLQMDS LRPEDTGVYFCARHGDD PAWFAYWGQGTPVTVSS (SEQ ID NO.: 679) | DIQLTQSPSSLSASVGD RVTITCSVSSISSNNL HWYQQKPGKAPKPWIYG TSNLASGVPSRFSGSGS GTDYTFTISSLQPEDIA TYYCQQWSSYPYMYTFG QGTKVEIK (SEQ ID NO.: 779) |
| M9346A | huMOV19 (vLCv1.00) | FOLR1 | QVQLVQSGAEVVKPGAS VKISCKASGYTFTGYFM NWVKQSPGQSLEWIGRI HPYDGDTFYNQKFQGKA TLTVDKSSNTAHMELLS LTSEDFAVYYCTRYDGS RAMDYWGQGTTVTVSS (SEQ ID NO.: 680) | DIVLTQSPLSLAVSLGQ PAIISCKASQSVSFAGT SLMHWYHQKPGQQPRLL IYRASNLEAGVPDRFSG SGSKTDFTLNISPVEAE DAATYYCQQSREYPYTF GGGTKLEIK (SEQ ID NO.: 780) |
| M9346A | huMOV19 (vLCv1.60) | FOLR1 | QVQLVQSGAEVVKPGAS VKISCKASGYTFTGYFM NWVKQSPGQSLEWIGRI | DIVLTQSPLSLAVSLGQ PAIISCKASQSVSFAGT SLMHWYHQKPGQQPRLL |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | | HPYDGDTFYNQKFQGKATLTVDKSSNTAHMELLSLTSEDFAVYYCTRYDGSRAMDYWGQGTTVTVSS (SEQ ID NO.: 681) | IYRASNLEAGVPDRFSGSGSKTDFTLTISPVEAEDAATYYCQQSREYPYTFGGGTKLEIK (SEQ ID NO.: 781) |
| | 26B3.F2 | FOLR1 | GPELVKPGASVKISCKASDYSFTGYFMNWVMQSHGKSLEWIGRIFPYNGDTFYNQKFKGRATLTVDKSSTAHMELRSLASEDSAVYFCARGTHYFDYWGQGTTLTVSS (SEQ ID NO.: 682) | PASLSASVGETVTITCRTSENIFSYLAWYQQKQGISPQLLVYNAKTLAEGVPSRFSGSGSGTQFSLKINSLQPEDFGSYYCQHHYAFPWTFGGGSKLEIK (SEQ ID NO.: 782) |
| RG7686 | GC33 | GPC3 | QVQLVQSGAEVKKPGASVKVSCKASGYTFTDYEMHWVRQAPGQGLEWMGALDPKTGDTAYSQKFKGRVTLTADKSTSTAYMELSSLTSEDTAVYYCTRFSYTYWGQGTLVTVSS (SEQ ID NO.: 683) | DVVMTQSPLSLPVTPGEPASISCRSSQSLVHSNGNTYLHWYLQKPGQSPQLLIYKVSNRFSGVPDRFSGSGSGTDFTLKISRVEAEDVGVYYCSQNTHVPPTFGQGTKLEIK (SEQ ID NO.: 783) |
| | 4A6 | GPC3 | EVQLVQSGAEVKKPGESLKISCKGSGYSFTSYWIAWVRQMPGKGLEWMGIIFPGDSDTRYSPSFQGQVTISADRSIRTAYLQWSSLKASDTALYYCARTREGYFDYWGQGTLVTVSS (SEQ ID NO.: 684) | EIVLTQSPGTLSLSPGERATLSCRAVQSVSSSYLAWYQQKPGQAPRLLIYGASSRATGIPDRFSGSGSGTDFTLTISRLEPEDFAVYYCQQYGSSPTFGGGTKVEIK (SEQ ID NO.: 784) |
| | 11E7 | GPC3 | EVQLVQSGAEVKKPGESLKISCKGSGYSFTNYWIAWVRQMPGKGLEWMGIIYPGDSDTRYSPSFQGQVTISADKSIRTAYLQWSSLKASDTAMYYCARTREGYFDYWGQGTLVTVSS (SEQ ID NO.: 685) | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK (SEQ ID NO.: 785) |
| | 16D10 | GPC3 | EVQLVQSGADVTKPGESLKISCKVSGYRFTNYWIGWMRQMSGKGLEWMGIIYPGDSDTRYSPSFQGHVTISADKSINTAYLRWSSLKASDTAIYYCARTREGFFDYWGQGTPVTVSS (SEQ ID NO.: 686) | EILLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTKVEIK (SEQ ID NO.: 786) |
| AMG-595 | | EGFR | QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSS (SEQ ID NO.: 687) | DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK (SEQ ID NO.: 787) |
| Erubitux™ | cetutximab | EGFR | QVQLKQSGPGLVQPSQSLSITCTVSGFSLTNYGVHWVRQSPGKGLEWLGVIWSGGNTDYNTPFTSRLSINKDNSKSQVFFKMNLQSNDTAIYYCARALTYYDYEFAYWGQGTLVTVSA (SEQ ID NO.: 688) | DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK (SEQ ID NO.: 788) |
| GA201 | Imgatuzumab | EGFR | QVQLVQSGAEVKKPGSSVKVSCKASGFTFTDYKIHWVRQAPGQGLEWMGYFNPNSGYSTYAQKFQGRVTITADKSTSTAYMELSS | DIQMTQSPSSLSASVGDRVTITCRASQGINNYLNWYQQKPGKAPKRLIYNTNNLQTGVPSRFSGSGSGTEFTLTISSLQPEDFAT |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | | LRSEDTAVYYCARLSPG GYYVMDAWGQGTTVTVS S (SEQ ID NO.: 689) | YYCLQHNSFPTFGQGTK LEIK (SEQ ID NO.: 789) |
| Humax | zalutumumab | EGFR | QVQLVESGGGVVQPGRS LRLSCAASGFTFSTYGM HWVRQAPGKGLEWVAVI WDDGSYKYYGDSVKGRF TISRDNSKNTLYLQMNS LRAEDTAVYYCARDGIT MVRGVMKDYFDYWGQGT LVTVSS (SEQ ID NO.: 690) | AIQLTQSPSSLSASVGD RVTITCRASQDISSALV WYQQKPGKAPKLLIYDA SSLESGVPSRFSGSESG TDFTLTISSLQPEDFAT YYCQQFNSYPLTFGGGT KVEIK (SEQ ID NO.: 790) |
| IMC-11F8 | necitumumab | EGFR | QVQLQESGPGLVKPSQT LSLTCTVSGGSISSGDY YWSWIRQPPGKGLEWIG YIYYSGSTDYNPSLKSR VTMSVDTSKNQFSLKVN SVTAADTAVYYCARVSI FGVGTFDYWGQGTLVTV SS (SEQ ID NO.: 691) | EIVMTQSPATLSLSPGE RATLSCRASQSVSSYLA WYQQKPGQAPRLLIYDA SNRATGIPARFSGSGSG TDFTLTISSLEPEDFAV YYCHQYGSTPLTFGGGT KAEIK (SEQ ID NO.: 791) |
| MM-151 | P1X | EGFR | QVQLVQSGAEVKKPGSS VKVSCKASGGTFSSYAI SWVRQAPGQGLEWMGSI IPIFGTVNYAQKFQGRV TITADESTSTAYMELSS LRSEDTAVYYCARDPSV NLYWYFDLWGRGTLVTV SS (SEQ ID NO.: 692) | DIQMTQSPSTLSASVGD RVTITCRASQSISSWWA WYQQKPGKAPKLLIYDA SSLESGVPSRFSGSGSG TEFTLTISSLQPDDFAT YYCQQYHAHPTTFGGGT KVEIK (SEQ ID NO.: 792) |
| MM-151 | P2X | EGFR | QVQLVQSGAEVKKPGSS VKVSCKASGGTFGSYAI SWVRQAPGQGLEWMGSI IPIFGAANPAQKSQGRV TITADESTSTAYMELSS LRSEDTAVYYCAKMGRG KVAFDIWGQGTMVTVSS (SEQ ID NO.: 693) | DIVMTQSPDSLAVSLGE RATINCKSSQSVLYSPN NKNYLAWYQQKPGQPPK LLIYWASTRESGVPDRF SGSGSGTDFTLTISSLQ AEDVAVYYCQQYYGSPI TFGGGTKVEIK (SEQ ID NO.: 793) |
| MM-151 | P3X | EGFR | QVQLVQSGAEVKKPGAS VKVSCKASGYAFTSYGI NWVRQAPGQGLEWMGWI SAYNGNTYYAQKLRGRV TMTTDTSTSTAYMELRS LRSDDTAVYYCARDLGG YGSGSVPFDPWGQGTLV TVSS (SEQ ID NO.: 694) | EIVMTQSPATLSVSPGE RATLSCRASQSVSSNLA WYQQKPGQAPRLLIYGA STRATGIPARFSGSGSG TEFTLTISSLQSEDFAV YYCQDYRTWPRRVFGGG TKVEIK (SEQ ID NO.: 794) |
| TheraCIM | nimotuzumab | EGFR | QVQLQQSGAEVKKPGSS VKVSCKASGYTFTNYYI YWVRQAPGQGLEWIGGI NPTSGGSNFNEKFKTRV TITADESSTTAYMELSS LRSEDTAFYFCTRQLW FDSDGRGFDFWGQGTTV TVSS (SEQ ID NO.: 695) | DIQMTQSPSSLSASVGD RVTITCRSSQNIVHSNG NTYLDWYQQTPGKAPKL LIYKVSNRFSGVPSRFS GSGSGTDFTFTISSLQP EDIATYYCFQYSHVPWT FGQGTKLQIT (SEQ ID NO.: 795) |
| Vectibix™ | panitumimab | EGFR | QVQLQESGPGLVKPSET LSLTCTVSGGSVSSGDY YWTWIRQSPGKGLEWIG HIYYSGNTNYNPSLKSR LTISIDTSKTQFSLKLS SVTAADTAIYYCVRDRV TGAFDIWGQGTMVTVSS (SEQ ID NO.: 696) | DIQMTQSPSSLSASVGD RVTITCQASQDISNYLN WYQQKPGKAPKLLIYDA SNLETGVPSRFSGSGSG TDFTFTISSLQPEDIAT YFCQHFDHLPLAFGGGT KVEIK (SEQ ID NO.: 796) |
| 07D06 | | EGFR | QIQLVQSGPELKKPGET VKISCKASGYTFTEYPI | DVVMTQTPLSLPVSLGD QASISCRSSQSLVHSNG |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | | HWVKQAPGKGFKWMGMI YTDIGKPTYAEEFKGRF AFSLETSASTAYLQINN LKNEDTATYFCVRDRYD SLFDYWGQGTTLTVSS (SEQ ID NO.: 697) | NTYLHWYLQKPGQSPKL LIYKVSNRFSGVPDRFS GSGSGTDFTLKISRVEA EDLGVYFCSQSTHVPWT FGGGTKLEIK (SEQ ID NO.: 797) |
| 12D03 | | EGFR | EMQLVESGGGFVKPGGS LKLSCAASGFAFSHYDM SWVRQTPKQRLEWVAYI ASGGDITYYADTVKGRF TISRDNAQNTLYLQMSS LKSEDTAMFYCSRSSYG NNGDALDFWGQGTSVTV SS (SEQ ID NO.: 698) | DVVMTQTPLSLPVSLGD QASISCRSSQSLVHSNG NTYLHWYLQKPGQSPKL LIYKVSNRFSGVPDRFS GSGSGTDFTLKISRVEA EDLGVYFCSQSTHVLTF GSGTKLEIK (SEQ ID NO.: 798) |
| | C1 | HER2 | QVQLVESGGGLVQPGGS LRLSCAASGFTFSSYAM GWVRQAPGKGLEWVSSI SGSSRYITYADSVKGRF TISRDNSKNTLYLQMNS LRAEDTAVYYCAKMDAS GSYFNFWGQGTLVTVSS (SEQ ID NO.: 699) | QSPSFLSAFVGDRITIT CRASPGIRNYLAWYQQK PGKAPKLLIYAASTLQS GVPSRFSGSGSGTDFTL TISSLQPEDFATYYCQQ YNSYPLSFGGGTKVEIK (SEQ ID NO.: 799) |
| Erbicin | | HER2 | QVQLLQSAAEVKKPGES LKISCKGSGYSFTSYWI GWVRQMPGKGLEWMGII YPGDSDTRYSPSFQGQV TISADKSISTAYLQWSS LKASDTAVYYCARWRDS PLWGQGTLVTVSS (SEQ ID NO.: 700) | QAVVTQEPSFSVSPGGT VTLTCGLSSGSVSTSYY PSWYQQTPGQAPRTLIY STNTRSSGVPDRFSGSI LGNKAALTITGAQADDE SDYYCVLYMGSGQYVFG GGTKLTVL (SEQ ID NO.: 800) |
| Herceptin | trastuzumab | HER2 | EVQLVESGGGLVQPGGS LRLSCAASGFNIKDTYI HWVRQAPGKGLEWVARI YPTNGYTRYADSVKGRF TISADTSKNTAYLQMNS LRAEDTAVYYCSRWGGD GFYAMDYWGQGTLVTVS S (SEQ ID NO.: 701) | DIQMTQSPSSLSASVGD RVTITCRASQDVNTAVA WYQQKPGKAPKLLIYSA SFLYSGVPSRFSGSRSG TDFTLTISSLQPEDFAT YYCQQHYTTPPTFGQGT KVEIK (SEQ ID NO.: 801) |
| MAGH22 | margetuximab | HER2 | QVQLQQSGPELVKPGAS LKLSCTASGFNIKDTYI HWVKQRPEQGLEWIGRI YPTNGYTRYDPKFQDKA TITADTSSNTAYLQVSR LTSEDTAVYYCSRWGGD GFYAMDYWGQGASVTVS S (SEQ ID NO.: 702) | DIVMTQSHKFMSTSVGD RVSITCKASQDVNTAVA WYQQKPGHSPKLLIYSA SFRYTGVPDRFTGSRSG TDFTFTISSVQAEDLAV YYCQQHYTTPPTFGGGT KVEIK (SEQ ID NO.: 802) |
| MM-302 | F5 | HER2 | QVQLVESGGGLVQPGGS LRLSCAASGFTFRSYAM SWVRQAPGKGLEWVSAI SGRGDNTYYADSVKGRF TISRDNSKNTLYLQMNS LRAEDTAVYYCAKMTSN AFAFDYWGQGTLVTVSS (SEQ ID NO.: 703) | QSVLTQPPSVSGAPGQR VTISCTGSSSNIGAGYG VHWYQQLPGTAPKLLTY GNTNRPSGVPDRFSGFK SGTSASLAITGLQAEDE ADYYCQFYDSSLSGWVF GGGTKLTVL (SEQ ID NO.: 803) |
| Perjeta | pertuzumab | HER2 | EVQLVESGGGLVQPGGS LRLSCAASGFTFTDYTM DWVRQAPGKGLEWVADV NPNSGGSIYNQRFKGRF TLSVDRSKNTLYLQMNS LRAEDTAVYYCARNLGP SFYFDYWGQGTLVTVSS (SEQ ID NO.: 704) | DIQMTQSPSSLSASVGD RVTITCKASQDVSIGVA WYQQKPGKAPKLLIYSA SYRYTGVPSRFSGSGSG TDFTLTISSLQPEDFAT YYCQQYYTYPYTFGQGT KVEIK (SEQ ID NO.: 804) |
| MM-121/ SAR256212 | | HER3 | EVQLLESGGGLVQPGGS LRLSCAASGFTFSHYVM | QSALTQPASVSGSPGQS ITISCTGTSSDVGSYNV |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | | AWVRQAPGKGLEWVSSI SSSGGWTLYADSVKGRF TISRDNSKNTLYLQMNS LRAEDTAVYYCTRGLKM ATIFDYWGQGTLVTVSS (SEQ ID NO.: 705) | VSWYQQHPGKAPKLITY EVSQRPSGVSNRFSGSK SGNTASLTISGLQTEDE ADYYCCSYAGSSIFVIF GGGTKVTVL (SEQ ID NO.: 805) |
| MEHD7945A | Duligotumab | EGFR/HER3 | EVQLVESGGGLVQPGGS LRLSCAASGFTLSGDWI HWVRQAPGKGLEWVGEI SAAGGYTDYADSVKGRF TISADTSKNTAYLQMNS LRAEDTAVYYCARESRV SFEAAMDYWGQGTLVTV SS (SEQ ID NO.: 706) | DIQMTQSPSSLSASVGD RVTITCRASQNIATDVA WYQQKPGKAPKLLIYSA SFLYSGVPSRFSGSGSG TDFTLTISSLQPEDFAT YYCQQSEPEPYTFGQGT KVEIK (SEQ ID NO.: 806) |
| MM-111 | | HER2/3 | QVQLQESGGGLVKPGGS LRLSCAASGFTFSSYWM SWVRQAPGKGLEWVANI NRDGSASYYVDSVKGRF TISRDDAKNSLYLQMNS LRAEDTAVYYCARDRGV GYFDLWGRGTLVTVSS (SEQ ID NO.: 707) | QSALTQPASVSGSPGQS ITISCTGTSSDVGGYNF VSWYQQHPGKAPKLMIY DVSDRPSGVSDRFSGSK SGNTASLIISGLQADDE ADYYCSSYGSSSTHVIF GGGTKVTVL (SEQ ID NO.: 807) |
| MM-111 | | HER2/3 | QVQLVQSGAEVKKPGES LKISCKGSGYSFTSYWI AWVRQMPGKGLEYMGLI YPGDSDTKYSPSFQGQV TISVDKSVSTAYLQWSS LKPSDSAVYFCARHDVG YCTDRTCAKWPEWLGVW GQGTLVTVSS (SEQ ID NO.: 708) | QSVLTQPPSVSAAPGQK VTISCSGSSSNIGNNYV SWYQQLPGTAPKLLIYD HTNRPAGVPDRFSGSKS GTSASLAISGFRSEDEA DYYCASWDYTLSGWVFG GGTKLTVL (SEQ ID NO.: 808) |
| | Hu3S193 | Lewis-Y | EVQLVESGGGVVQPGRS LRLSCSTSGFTFSDYYM YWVRQAPGKGLEWVAYM SNVGAITDYPDTVKGRF TISRDNSKNTLFLQMDS LRPEDTGVYFCARGTRD GSWFAYWGQGTPVTVSS (SEQ ID NO.: 709) | DIQMTQSPSSLSASVGD RVTITCRSSQRIVHSNG NTYLEWYQQTPGKAPKL LIYKVSNRFSGVPSRFS GSGSGTDFTFTISSLQP EDIATYYCFQGSHVPFT FGQGTKLQIT (SEQ ID NO.: 809) |
| BAY 94-9343 | anetumab ravtansine | Mesothelin | QVELVQSGAEVKKPGES LKISCKGSGYSFTSYWI GWVRQAPGKGLEWMGII DPGDSRTRYSPSFQGQV TISADKSISTAYLQWSS LKASDTAMYYCARGQLY GGTYMDGWGQGTLVTVS S (SEQ ID NO.: 710) | DIALTQPASVSGSPGQS ITISCTGTSSDIGGYNS VSWYQQHPGKAPKLMIY GVNNRPSGVSNRFSGSK SGNTASLTISGLQAEDE ADYYCSSYDIESATPVF** GGGTKLTVL (SEQ ID NO.: 810) |
| | SS1 | Mesothelin | QVQLQQSGPELEKPGAS VKISCKASGYSFTGYTM NWVKQSHGKSLEWIGLI TPYNGASSYNQKFRGKA TLTVDKSSSTAYMDLLS LTSEDSAVYFCARGGYD GRGFDYWGQGTTVTVSS (SEQ ID NO.: 711) | DIELTQSPAIMSASPGE KVTMTCSASSSVSYMHW YQQKSGTSPKRWIYDTS KLASGVPGRFSGSGSGN SYSLTISSVEAEDDATY YCQQWSGYPLTFGAGTK LEIK (SEQ ID NO.: 811) |
| | | Mesothelin | QVYLVESGGGVVQPGRS LRLSCAASGITFSIYGM HWVRQAPGKGLEWVAVI WYDGSHEYYADSVKGRF TISRDNSKNTLYLLMNS LRAEDTAVYYCARDGDY YDSGSPLDYWGQGTL VTVSS (SEQ ID NO.: 712) | EIVLTQSPATLSLSPGE RATLSCRASQSVSSYLA WYQQKPGQAPRLLIYDA SNRATGIPARFSGSGSG TDFTLTISSLEPEDFAV YYCQQRSNWPLTFGGGT KVEIK (SEQ ID NO.: 812) |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | Mesothelin | QVHLVESGGGVVQPGRSLRLSCVASGITFRIYGM HWVRQAPGKGLEWVAVL WYDGSHEYTADSVKGRFTISRDNSKNTLYLQMNSLRAEDTAIYYCARDGDY YDSGSPLDYWGQGTLVTVSS (SEQ ID NO.: 713) | EIVLTQSPATLSLSPGERATLSCRASQSVSSYLA WYQQKPGQAPRLLIYDA SNRATGIPARFSGSGSGTDFTLTISSLEPEDFAVYYCQQRSNWPLTFGGGTKVEIK (SEQ ID NO.: 813) |
| | | Mesothelin | EVHLVESGGGLVQPGGSLRLSCAASGFTFSRYWM SWVRQAQGKGLEWVASI KQAGSEKTYVDSVKGRFTISRDNAKNSLSLQMNSLRAEDTAVYYCAREGAY YYDSASYYPYYTYYSMD VWGQGTTVTVSS (SEQ ID NO.: 714) | EIVLTQSPGTLSLSPGERATLSCRASQSVSSSYL AWYQQKPGQAPRLLIYG ASSRATGIPDRFSGSGSGTDFTLTISRLEPEDFAVYYCQQYGSSQYTFGQGTKLEIK (SEQ ID NO.: 814) |
| MORAb-009 | amatuximab | Mesothelin | QVQLQQSGPELEKPGASVKISCKASGYSFTGYTM NWVKQSHGKSLEWIGLI TPYNGASSYNQKFRGKATLTVDKSSSTAYMDLLSLTSEDSAVYFCARGGYD GRGFDYWGSGTPVTVSS (SEQ ID NO.: 715) | DIELTQSPAIMSASPGEKVTMTCSASSSVSYMHW YQQKSGTSPKRWIYDTS KLASGVPGRFSGSGSGNSYSLTISSVEAEDDATYYCQQWSKHPLTFGSGTKVEIK (SEQ ID NO.: 815) |
| hPAM4 | | MUC-1 | EVQLQESGPELVKPGASVKMSCKASGYTFPSYVL HWVKQKPGQGLEWIGYI NPYNDGTQYNEKFKGKATLTSDKSSSTAYMELSRLTSEDSAVYYCARGFGG SYGFAYWGQGTLITVSA (SEQ ID NO.: 716) | DIVMTQSPAIMSASPGEKVTMTCSASSSVSSSYL YWYQQKPGSSPKLWIYS TSNLASGVPARFSGSGSGTSYSLTISSMEAEDAASYFCHQWNRYPYTFGGGTKLEIK (SEQ ID NO.: 816) |
| hPAM4-Cide | clivatuzumab | MUC1 | QVQLQQSGAEVKKPGASVKVSCEASGYTFPSYVL HWVKQAPGQGLEWIGYI NPYNDGTQTNKKFKGKATLTRDTSINTAYMELSRLRSDDTAVYYCARGFGG SYGFAYNGQGTLVTVSS (SEQ ID NO.: 717) | DIQLTQSPSSLSASVGDRVTMTCSASSSVSSSYL YWYQQKPGKAPKLWIYS TSNLASGVPARFSGSGSGTDFTLTISSLQPEDSASYFCHQWNRYPYTFGGGTRLEIK (SEQ ID NO.: 817) |
| SAR566658 | huDS6v1.01 | MUC1 | QAQLQVSGAEVVKPGASVKMSCKASGYTFTSYNM HWVKQTPGQGLEWIGYI YPGNGATNYNQKFQGKATLTADTSSSTAYMQISSLTSEDSAVYFCARGDSV PFAYWGQGTLVTVSA (SEQ ID NO.: 718) | EIVLTQSPATMSASPGERVTITCSAHSSVSFMHW FQQKPGTSPKLWIYSTS SLASGVPARFGGSGSGTSYSLTISSMEAEDAATYYCQQRSSFPLTFGAGTKLELK (SEQ ID NO.: 818) |
| Theragyn | Pemtumomab muHMFG1 | MUC1 | QVQLQQSGAELMKPGASVKISCKATGYTFSAYWI EWVKQRPGHGLEWIGEI LPGSNNSRYNEKFKGKATFTADTSSNTAYMQLSSLTSEDSAVYYCSRSYDF AWFAYWGQGTPVTVSA (SEQ ID NO.: 719) | DIVMSQSPSSLAVSVGEKVTMSCKSSQSLLYSSN QKTYLAWYQQKPGQSPKLLIYWASTRESGVPDRFTGGGSGTDFTLTISSVKAEDLAVYYCQQYYRYPR TFGGGTKLEIK (SEQ ID NO.: 819) |
| Therex | Sontuzumab huHMFG1 AS1402 R1150 | MUC1 | QVQLVQSGAEVKKPGASVKVSCKASGYTFSAYWI EWVRQAPGKGLEWVGEI LPGSNNSRYNEKFKGRVTVTRDTSTNTAYMELSSLRSEDTAVYYCARSYDF AWFAYWGQGTLVTVSS (SEQ ID NO.: 720) | DIQMTQSPSSLSASVGDRVTITCKSSQSLLYSSN QKTYLAWYQQKPGKAPKLLIYWASTRESGVPSRFSGSGSGTDFTFTISSLQPEDIATYYCQQYYRYPR TFGQGTKVEIK (SEQ ID NO.: 820) |

TABLE 5-continued

Anti-target Cell Monoclonal Antibodies and Sequences

| Trade Name | Antibody Name | Target Cell Marker | VH Sequence | VL Sequence |
|---|---|---|---|---|
| MDX-1105 or BMS-936559 | | PD-L1 | QVQLVQSGAEVKKPGSSVKVSCKTSGDTFSTYAI SWVRQAPGQGLEWMGGI IPIFGKAHYAQKFQGRVTITADESTSTAYMELSSLRSEDTAVYFCARKFHF VSGSPFGMDVWGQGTTVTVSS (SEQ ID NO.: 721) | EIVLTQSPATLSLSPGERATLSCRASQSVSSYLA WYQQKPGQAPRLLIYDA SNRATGIPARFSGSGSGTDFTLTISSLEPEDFAVYYCQQRSNWPTFGQGTKVEIK (SEQ ID NO.: 821) |
| MEDI-4736 | durvalumab | PD-L1 | EVQLVESGGGLVQPGGSLRLSCAASGFTFSRYWM SWVRQAPGKGLEWVANI KQDGSEKYYVDSVKGRFTISRDNAKNSLYLQMNSLRAEDTAVYYCAREGGW FGELAFDYWGQGTLVTVSS (SEQ ID NO.: 722) | EIVLTQSPGTLSLSPGERATLSCRASQRVSSSYL AWYQQKPGQAPRLLIYD ASSRATGIPDRFSGSGSGTDFTLTISRLEPEDFAVYYCQQYGSLPWTFGQGTKVEIK (SEQ ID NO.: 822) |
| MPDL3280A | atezolizumab | PD-L1 | EVQLVESGGGLVQPGGSLRLSCAASGFTFSDSWI HWVRQAPGKGLEWVAWI SPYGGSTYYADSVKGRFTISADTSKNTAYLQMNSLRAEDTAVYYCARRHWP GGFDYWGQGTLVTVSS (SEQ ID NO.: 723) | DIQMTQSPSSLSASVGDRVTITCRASQDVSTAVA WYQQKPGKAPKLLIYSA SFLYSGVPSRFSGSGSGTDFTLTISSLQPEDFATYYCQQYLYHPATFGQGTKVEIK (SEQ ID NO.: 823) |
| MSB0010718C | avelumab | PD-L1 | EVQLLESGGGLVQPGGSLRLSCAASGFTFSSYIM MWVRQAPGKGLEWVSSI YPSGGITFYADTVKGRFTISRDNSKNTLYLQMNSLRAEDTAVYYCARIKLG TVTTVDYWGQGTLVTVSS (SEQ ID NO.: 724) | QSALTQPASVSGSPGQSITISCTGTSSDVGGYNY VSWYQQHPGKAPKLMIYDVSNRPSGVSNRFSGSKSGNTASLTISGLQAEDEADYYCSSYTSSSTRVFGTGTKVTVL (SEQ ID NO.: 824) |
| MLN591 | | PSMA | EVQLVQSGPEVKKPGATVKISCKTSGYTFTEYTI HWVKQAPGKGLEWIGNI NPNNGGTTYNQKFEDKATLTVDKSTDTAYMELSSLRSEDTAVYYCAAGWNF DYWGQGTLLTVSS (SEQ ID NO.: 725) | DIQMTQSPSSLSTSVGDRVTLTCKASQDVGTAVD WYQQKPGSPKLLIYWA STRHTGIPSRFSGSGSGTDFTLTISSLQPEDFADYYCQQYNSYPLTFGPGTKVDIK (SEQ ID NO.: 825) |
| MT112 | pasotuxizumab | PSMA | QVQLVESGGGLVKPGESLRLSCAASGFTFSDYYM YWVRQAPGKGLEWVAII SDGGYYTYYSDIIKGRFTISRDNAKNSLYLQMNSLKAEDTAVYYCARGFPL LRHGAMDYWGQGTLVTVSS (SEQ ID NO.: 726) | DIQMTQSPSSLSASVGDRVTITCKASQNVDTNVAWYQQKPGQAPKSLIYSA SYRYSDVPSRFSGSASGTDFTLTISSVQSEDFATYYCQQYDSYPYTFGGGTKLEIK (SEQ ID NO.: 826) |
| | | ROR1 | QEQLVESGGRLVTPGGSLTLSCKASGFDFSAYYM SWVRQAPGKGLEWIATI YPSSGKTYYATWVNGRFTISSDNAQNTVDLQMNSLTAADRATYFCARDSYA DDGALFNIWGPGTLVTISS (SEQ ID NO.: 727) | ELVLTQSPSVSAALGSPAKITCTLSSAHKTDTID WYQQLQGEAPRYLMVQSDGSYTKRPGVPDRFSGSSSGADRYLIIPSVQADDEADYYCGADYIGGYVF GGGTQLTVTG (SEQ ID NO.: 827) |
| | | ROR1 | EVKLVESGGGLVKPGGSLKLSCAASGFTFSSYAM SWVRQIPEKRLEWVASI SRGGTTYYPDSVKGRFT | DIKMTQSPSSMYASLGERVTITCKASPDINSYLS WFQQKPGKSPKTLIYRA NRLVDGVPSRFSGGGSG |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | | ISRDNVRNILYLQMSSL RSEDTAMYYCGRDYDG YYAMDYWGQGTSVTVSS (SEQ ID NO.: 728) | QDYSLTINSLEYEDMGI YYCLQYDEFPYTFGGGT KLEMK (SEQ ID NO.: 828) |
| | | ROR1 | QSLEESGGRLVTPGTPL TLTCTVSGIDLNSHWMS WVRQAPGKLEWIGIIA ASGSTYYANWAKGRFTI SKTSTTVDLRIASPTTE DTATYFCARDYGDYRLV TFNIWGPGTLVTVSS (SEQ ID NO.: 729) | ELVMTQTPSSVSAAVGG TVTINCQASQSIGSYLA WYQQKPGQPPKLLIYYA SNLASGVPSRFSGSGSG TEYTLTISGVQREDAAT YYCLGSLSNSDNVFGGG TELEIL (SEQ ID NO.: 829) |
| | | ROR1 | QSVKESEGDLVTPAGNL TLTCTASGSDINDYPIS WVRQAPGKLEWIGFIN SGGSTWYASWVKGRFTI SRTSTTVDLKMTSLTTD DTATYFCARGYSTYYCD FNIWGPGTLVTISS (SEQ ID NO.: 730) | ELVMTQTPSSTSGAVGG TVTINCQASQSIDSNLA WFQQKPGQPPTLLIYRA SNLASGVPSRFSGSRSG TEYTLTISGVQREDAAT YYCLGGVGNVSYRTSFG GGTEVVVK (SEQ ID NO.: 830) |
| CC49 (Humanized) | | TAG-72 | QVQLVQSGAEVVKPGAS VKISCKASGYTFTDHAI HWVKQNPGQRLEWIGYF SPGNDDFKYNERFKGKA TLTADTSASTAYVELSS LRSEDTAVYFCTRSLNM AYWGQGTLVTVSS (SEQ ID NO.: 731) | DIVMSQSPDSLAVSLGE RVTLNCKSSQSLLYSGN QKNYLAWYQQKPGQSPK LLIYWASARESGVPDRF SGSGSGTDFTLTISSVQ AEDVAVYYCQQYYSYPL TFGAGTKLELK (SEQ ID NO.: 831) |
| | Murine A1 | TPBG/5T4 | QIQLVQSGPELKKPGET VKISCKASGYTFTNFGM NWVKQGPGEGLKWMGWI NTNTGEPRYAEEFKGRX AFSLETTASTAYLQINN LKNEDTATYFCARDWDG AYFFDYWGQTTLVTVSS (SEQ ID NO.: 732) | SIVMTQTPKFLLVSAGD VRTITCKASQSVSNDVA WYQQKPGQSPKLLINFA TNRYTGVPNRFTGSGYG TDFTFTISTVQAEDLAV YFCQQDYSSPWTFGGGT KLEIK (SEQ ID NO.: 832) |
| | Murine A2 | TPBG/5T4 | QVQLQQSRPELVKPGAS VKMSCKASGYTFTDYVI SWVKQRTGQGLEWIGEI YPGSNSIYYNEKFKGRA TLTADKSSSTAYMQLSS LTSEDSAVYFCAMGGNY GFDYWGQGTTLVTVSS (SEQ ID NO.: 733) | SVIMSRGQIVLTQSPAI MSASLGERVTLTCTASS SVNSNYLHWYQQKPGSS PKLWIYSTSNLASGVPA RFSGSGSGTSYSLTISS MEAEDAATYYCHQYHRS PLTFGAGTKLELK (SEQ ID NO.: 833) |
| | Murine A3 | TPBG/5T4 | EVQLVESGGGLVQPKGS LKLSCAASGFTFNTYAM NWVRQAPGKGLEWVARI RSKSNNYATYYADSVKD RFTISRDDSQSMLYLQM NNLKTEDTAMYXCVRQW DYDVRAMNYWGQGTSVT VSS (SEQ ID NO.: 734) | DIVMTQSHIFMSTSVGD RVSITCKASQDVDTAVA WYQQKPGQSPKLLIYWA STRLTGVPDRFTGSGSG TDFTLTISNVQSEDLAD YFCQQYSSYPYTFGGGT KLEIK (SEQ ID NO.: 834) |
| IMMU-132 | hRS-7 | TROP-2 | QVQLQQSGSELKKPGAS VKVSCKASGYTFTNYGM NWVKQAPGQGLKWMGWI NTYTGEPTYTDDFKGRF AFSLDTSVSTAYLQISS LKADDTAVYFCARGGFG SSYWYFDVWGQGSLVTV SS (SEQ ID NO.: 735) | DIQLTQSPSSLSASVGD RVSITCKASQDVSINA WYQQKPGKAPKLLIYSA SYRYTGVPDRFSGSGSG TDFTLTISSLQPEDFAV YYCQQHYITPLTFGAGT KVEIK (SEQ ID NO.: 835) |
| IMC-18F1 | icrucumab | VEGFR1 | QAQVVESGGGVVQSGRS LRLSCAASGFAFSSYGM HWVRQAPGKGLEWVAVI WYDGSNKYYADSVRGRF TISRDNSENTLYLQMNS | EIVLTQSPGTLSLSPGE RATLSCRASQSVSSSYL AWYQQKPGQAPRLLIYG ASSRATGIPDRFSGSGS GTDFTLTISRLEPEDFA |

TABLE 5-continued

Anti-target Cell Monoclonal Antibodies and Sequences

| Trade Name | Antibody Name | Target Cell Marker | VH Sequence | VL Sequence |
|---|---|---|---|---|
| | | | LRAEDTAVYYCARDHYG SGVHHYFYYGLDVWGQG TTVTVSS (SEQ ID NO.: 736) | VYYCQQYGSSPLTFGGG TKVEIK (SEQ ID NO.: 836) |
| Cyramza | ramucirumab | VEGFR2 | EVQLVQSGGGLVKPGGS LRLSCAASGFTFSSYSM NWVRQAPGKGLEWVSSI SSSSSYITYADSVKGRF TISRDNAKNSLYLQMNS LRAEDTAVYYCARVTDA FDIWGQGTMVTVSSA (SEQ ID NO.: 737) | DIQMTQSPSSVSASIGD RVTITCRASQGIDNWLG WYQQKPGKAPKLLIYDA SNLDTGVPSRFSGSGSG TYFTLTISSLQAEDFAV YFCQQAKAFPPTFGGGT KVDIK (SEQ ID NO.: 837) |
| g165DFM-PEG | alacizumab-pegol | VEGFR2 | EVQLVESGGGLVQPGGS LRLSCAASGFTFSSYGM SWVRQAPGKGLEWVATI TSGGSYTYYVDSVKGRF TISRDNAKNTLYLQMNS LRAEDTAVYYCVRIGED ALDYWGQGTLVTVSS (SEQ ID NO.: 738) | DIQMTQSPSSLSASVGD RVTITCRASQDIAGSLN WLQQKPGKAIKRLIYAT SSLDSGVPKRFSGSRSG SDYTLTISSLQPEDFAT YYCLQYGSFPPTFGQGT KVEIK (SEQ ID NO.: 838) |
| Imclone6.64 | | VEGFR2 | KVQLQQSGTELVKPGAS VKVSCKASGYIFTEYII HWVKQRSGQGLEWIGWL YPESNIIKYNEKFKDKA TLTADKSSSTVYMELSR LTSEDSAVYFCTRHDGT NFDYWGQGTTLTVS (SEQ ID NO.: 739) | DIVLTQSPASLAVSLGQ RATISCRASESVDSYGN SFMHWYQQKPGQPPKLL IYRASNLESGIPARFSG SGSRTDFTLTINPVEAD DVATYYCQQSNEDPLTF SAGAGTKLELK (SEQ ID NO.: 839) |

* underlined & bolded sequences, if present, are CDRs within the VL and VH

TABLE 6

Intramolecular Long Linkers

| Linker # | Name | Amino Acid Sequence |
|---|---|---|
| L1 | (G4S)3 | GGGGSGGGGSGGGGS (SEQ ID NO.: 840) |
| L2 | MT110_18 | GEGTSTGSGGSGGSGGAD (SEQ ID NO.: 841) |
| L3 | MT103_18 | VEGGSGGSGGSGGSGGVD (SEQ ID NO.: 842) |
| L4 | UCHT1_29 | RTSGPGDGGKGGPGKGPGGEGTKGTGPGG (SEQ ID NO.: 843) |
| L5 | Y30 | GSGEGSEGEGGGEGSEGEGSGEGGEGEGSG (SEQ ID NO.: 844) |
| L6 | Y32 | TGSGEGSEGEGGGEGSEGEGSGEGGEGEGS GT (SEQ ID NO.: 845) |
| L7 | G1_30_3 | GATPPETGAETESPGETTGGSAESEPPGEG (SEQ ID NO.: 846) |
| L8 | G9_30_1 | GSAAPTAGTTPSASPAPPTGGSSAAGSPST (SEQ ID NO.: 847) |
| L9 | Y30_modified | GEGGESGGSEGEGSGEGEGGSSGGEGESEGG (SEQ ID NO.: 848) |
| L10 | G1_30_1 | STETSPSTPTESPEAGSGSGSPESPSGTEA (SEQ ID NO.: 849) |
| L11 | G1_30_2 | PTGTTGEPSGEGSEPEGSAPTSSTSEATPS (SEQ ID NO.: 850) |
| L12 | G1_30_4 | SESESEGEAPTGPGASTTPEPSESPTPETS (SEQ ID NO.: 851) |
| L13 | UCHT1_modified | PEGGESGEGTGPGTGGEPEGEGGPGGEGGT (SEQ ID NO.: 852) |

TABLE 7

Intermolecular Short Linkers

| Name | Amino Acid Sequence |
|---|---|
| S-1 | SGGGGS (SEQ ID NO: 853) |
| S-2 | GGGGS (SEQ ID NO: 854) |
| S-3 | GGS |
| S-4 | GSP |

V. Bulking Moieties and Extended Recombinant Polypeptides (XTEN)

In another aspect, the disclosure relates to recombinant polypeptides comprising at least a first bulking moiety that are incorporated into the subject compositions both in order to increase the mass and size of the construct, but that also serve to greatly reduce the ability of the binding moieties to bind their ligands when the molecule is in the intact, uncleaved state, described more fully, below. In some embodiments, the disclosure provides a recombinant polypeptide comprising a single bulking moiety fused to the N- or C-terminus of the RS that is located between the binding moiety and the bulking moiety. Non-limiting examples of bulking moieties include extended recombinant polypeptide (XTEN, as described herein, below); albumin binding domain; albumin; IgG binding domain; polypeptides of at least 350 amino acid residues consisting of proline, serine, and alanine; fatty acid; elastin-like protein (ELP) (the individual subunit or building blocks of ELPs are derived from a five amino acid motif found in human protein elastin that is repeated multiple times to form the ELP biopolymer, as described in WO2016081884),Fc domain, polyethylene glycol (PEG), PLGA, and hydoxylethyl starch.

In a preferred embodiment, the disclosure provides a recombinant polypeptide comprising at least a first XTEN fused to the N- or C-terminus of the RS, which, in turn, is fused to the adjacent binding moiety. In another embodiment, the recombinant polypeptide comprises two different XTEN sequences, wherein the two XTEN are each linked to two RS of the composition that, in turn, are linked to the binding moieties. In one embodiment, the recombinant polypeptide compositions comprise a first XTEN sequence having at least 90%, 91%, 92%, 93%, 94%, 95%, 96%, 97%, 98%, 99%, or 100% sequence identity, when optimally aligned, to an XTEN sequence of comparable length selected from the group of sequences set forth in Table 8 or Table 10. In another embodiment, the recombinant polypeptide comprises a first and a second XTEN sequence (XTEN1 and XTEN2), each sequence having at least 90%, 91%, 92%, 93%, 94%, 95%, 96%, 97%, 98%, 99%, or 100% sequence identity, when optimally aligned, to a sequence selected from sequences set forth in Table 8. In another embodiment, the recombinant polypeptide comprises a first and a second XTEN sequence (XTEN1 and XTEN2), each sequence having at least 90%, 91%, 92%, 93%, 94%, 95%, 96%, 97%, 98%, 99%, or 100% sequence identity, when optimally aligned, to a sequence selected from sequences set forth in Table 10.

Without being bound by theory, the incorporation of the bulking moiety was incorporated into the design of the subject compositions to confer certain properties; 1) provide recombinant polypeptide compositions with a bulking moiety XTEN that shields the binding moieties and reduces binding affinity for the target cell markers and effector cell antigens when the composition is in its intact, prodrug form; ii) provide recombinant polypeptide compositions with a bulking moiety XTEN that provides enhanced half-life when administered to a subject, iii) contribute to the solubility and stability of the intact composition, thereby enhancing the pharmaceutical properties of the subject compositions; and iv) provide recombinant polypeptide compositions with a bulking moiety XTEN that reduces extravasation in normal tissues and organs yet permits a degree of extravasation in diseased tissues (e.g., a tumor) with larger pore sizes in the vasculature, yet could be released from the composition by action of certain mammalian proteases, thereby permitting the binding moieties of the composition to more readily penetrate into the diseased tissues, e.g. a tumor, and to bind to and link together the target cell markers on the effector cell and tumor cell. To meet these needs, the disclosure provides compositions comprising one or more XTEN in which the XTEN provides increased mass and hydrodynamic radius to the resulting composition. The XTEN polypeptides of the embodiments provide certain advantages in the design of the subject compositions in that is provides not only provides increased mass and hydrodynamic radius, but its flexible, unstructured characteristics provides a shielding effect over the binding moieties of the composition, thereby reducing the likelihood of binding to antigens in normal tissues or the vasculature of normal tissues that don't express or express reduced levels of target cell markers and/or effector cell antigens, and enhances solubility and proper folding of the single chain antibody fragment binding moieties during their expression and recovery.

XTEN are polypeptides with non-naturally occurring, substantially non-repetitive sequences having a low degree or no secondary or tertiary structure under physiologic conditions, as well as additional properties described in the paragraphs that follow. XTEN typically have from at least about 100 to at least about 1000 or more amino acids, and more preferably at least about 200 to at least about 900 amino acids, of which the majority or the entirety are small hydrophilic amino acids selected from glycine, serine, threonine, glutamate, and proline. As used herein, XTEN specifically excludes whole antibodies or antibody fragments (e.g. single-chain antibodies and Fc fragments). XTEN polypeptides have utility as fusion partners in that they serve in various roles, conferring certain desirable properties when linked to a composition comprising, for example, the bispecific binding moieties of the subject AAC compositions described herein. The resulting compositions have enhanced properties, such as enhanced pharmacokinetic, physicochemical, pharmacologic, and improved toxicological and pharmaceutical properties compared to the corresponding binding moieties not linked to XTEN, making them useful in the treatment of certain conditions for which the binding moieties are known in the art to be used.

The unstructured characteristic and physicochemical properties of the XTEN result, in part, from the overall amino acid composition that is disproportionately limited to 4-6 types of hydrophilic amino acids, the sequence of the amino acids in a quantifiable, substantially non-repetitive design, and from the resulting length of the XTEN polypeptide. In an advantageous feature common to XTEN but uncommon to native polypeptides, the properties of XTEN disclosed herein are not tied to an absolute primary amino acid sequence, as evidenced by the diversity of the exemplary sequences of Tables 8 and 10 that, within varying ranges of length, possess similar properties and confer enhanced properties on the compositions to which they are linked, many of which are documented in the Examples. Indeed, it is specifically contemplated that the compositions of the disclosure not be limited to those XTEN specifically enumerated in Tables 8 or 10, but, rather, the embodiments include sequences having at least 90%, 91%, 92%, 93%, 94%, 95%, 96%, 97%, 98%, or 99% sequence identity, when optimally aligned, to the sequences of Table 8 or Table 10 as they exhibit the properties of XTEN described herein. It has been established that such XTEN have properties more like non-proteinaceous, hydrophilic polymers (such as polyethylene glycol, or "PEG") than they do proteins. The XTEN of the present disclosure exhibit one or more of the following advantageous properties: defined and uniform length (for a given sequence), conformational flexibility, reduced or lack of secondary structure, high degree of random coil formation, high degree of aqueous solubility, high degree of protease resistance, low immunogenicity, low binding to mammalian receptors, a defined degree of charge, and increased hydrodynamic (or Stokes) radii; properties that are similar to certain hydrophilic polymers (e.g., polyethylene glycol) that make them particularly useful as fusion partners.

The XTEN component(s) of the subject recombinant polypeptides and AAC are designed to behave like denatured peptide sequences under physiological conditions, despite the extended length of the polymer. "Denatured" describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In some embodiments, the disclosure provides compositions that comprise XTEN sequences that, under physiologic conditions, resemble denatured sequences that are substantially devoid of secondary structure under physiologic conditions. "Substantially devoid," as used in this context, means that at least about 80%, or about 90%, or about 95%, or about 97%, or at least about 99% of the XTEN amino acid residues of the XTEN sequence do not contribute to secondary structure, as measured or determined by the methods described herein, including algorithms or spectrophotometric assays.

A variety of well-established methods and assays are known in the art for determining and confirming the physicochemical properties of the subject XTEN and the subject polypeptide compositions into which they are incorporated. Such properties include but are not limited to secondary or tertiary structure, solubility, protein aggregation, stability, absolute and apparent molecular weight, purity and uniformity, melting properties, contamination and water content. The methods to measure such properties include analytical centrifugation, EPR, HPLC-ion exchange, HPLC-size exclusion chromatography (SEC), HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra, as does the lack of these structure elements. Secondary structure can also be predicted for a polypeptide sequence via certain computer programs or algorithms, such as the well-known Chou-Fasman algorithm (Chou, P. Y., et al. (1974) *Biochemistry*, 13: 222-45) and the Garnier-Osguthorpe-Robson algorithm ("GOR IV algorithm") (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure). Polypeptide sequences can be analyzed using the Chou-Fasman algorithm using sites on the world wide web at, for example, fasta.bioch.virginia.edu/fasta_www2/fasta_www. cgi?rm=misc1 and the GOR IV algorithm at npsa-pbil.ibcp.fr/cgi-bin/npsa_automat.pl?page=npsa_gor4.html (both accessed on Dec. 8, 2017). Random coil can be determined by a variety of methods, including by using intrinsic viscosity measurements, which scale with chain length in a conformation-dependent way (Tanford, C., Kawahara, K. & Lapanje, S. (1966) J. Biol. Chem. 241, 1921-1923), as well as by size-exclusion chromatography (Squire, P. G., Calculation of hydrodynamic parameters of random coil polymers from size exclusion chromatography and comparison with parameters by conventional methods. Journal of Chromatography, 1981, 5,433-442). Additional methods are disclosed in Arnau, et al., Prot Expr and Purif (2006) 48, 1-13.

In one embodiment, the XTEN sequences of the subject compositions have an alpha-helix percentage ranging from 0% to less than about 5% and a beta-sheet percentage ranging from 0% to less than about 5% as determined by the Chou-Fasman algorithm and at least about 90%, or at least about 91%, 92%, 93%, 94%, 95%, 96%, 97%, 98%, or 99% random coil formation as determined by the GOR IV algorithm. In another embodiment, the XTEN sequences of the disclosed compositions have an alpha-helix percentage less than about 2% and a beta-sheet percentage less than about 2% as determined by the Chou-Fasman algorithm and at least about 90% random coil formation as determined by the GOR IV algorithm. In another embodiment, the XTEN sequences of the compositions are substantially lacking secondary structure as measured by circular dichroism.

In one embodiment, the XTEN sequence used in the subject compositions of the disclosure is at least 90%, 91%, 92%, 93%, 94%, 95%, 96%, 97%, 98%, 99%, or 100% identical to a sequence selected from the group consisting of AE 144_1A, AE 144_2A, AEE144_2B, AE 144_3A, AE144_3B, AE 144_4A, AE 144_4B, AE 144_5A, AE 144_6B, AE288_1, AE288_2, AE288_3, AE284, AE292, AE576, AE864, AE864_2, AE865, AE866, AE867, AE867_2, and AE868.

In some embodiments, wherein less than 100% of amino acids of an XTEN in the subject compositions are selected from glycine (G), alanine (A), serine (S), threonine (T), glutamate (E) and proline (P), or wherein less than 100% of the sequence consists of the XTEN sequences of Table 8 or Table 10, the remaining amino acid residues of the XTEN are selected from any of the other 14 natural L-amino acids, but are preferentially selected from hydrophilic amino acids such that the XTEN sequence contains at least about 90%, 91%, 92%, 93%, 94%, 95%, 96%, 97%, 98%, or at least about 99% hydrophilic amino acids. The content of hydrophobic amino acids in the XTEN utilized in the subject compositions can be less than 5%, or less than 2%, or less than 1% hydrophobic amino acid content. Hydrophobic residues that are less favored in construction of XTEN include tryptophan, phenylalanine, tyrosine, leucine, isoleucine, valine, and methionine. Additionally, XTEN sequences can contain less than 5% or less than 4% or less than 3% or less than 2% or less than 1% or none of the following amino acids: methionine (for example, to avoid oxidation), or asparagine and glutamine (to avoid desamidation).

In one embodiment, the amino acid sequences for certain XTEN utilized in the AAC embodiments of the disclosure are shown in Table 8.

TABLE 8

XTEN Polypeptides

| XTEN Name | Amino Acid Sequence |
|---|---|
| AE144 | GSEPATSGSETPGTSESATPESGPGSEPATSGSETPGSPAGSPTSTEEGTSTEPSEGSAPGSEPATS GSETPGSEPATSGSETPGSEPATSGSETPGTSTEPSEGSAPGTSESATPESGPGSEPATSGSETPGT STEPSEGSAP (SEQ ID NO.: 855) |
| AE144_1A | SPAGSPTSTEEGTSESATPESGPGTSTEPSEGSAPGSPAGSPTSTEEGTSTEPSEGSAPGTSTEPSE GSAPGTSESATPESGPGSEPATSGSETPGSEPATSGSETPGSPAGSPTSTEEGTSESATPESGPGTS TEPSEGSAPG (SEQ ID NO.: 856) |
| AE144_2A | TSTEPSEGSAPGSPAGSPTSTEEGTSTEPSEGSAPGTSTEPSEGSAPGTSESATPESGPGTSTEPSE GSAPGTSESATPESGPGSEPATSGSETPGTSTEPSEGSAPGTSTEPSEGSAPGTSESATPESGPGTS ESATPESGPG (SEQ ID NO.: 857) |
| AE144_2B | TSTEPSEGSAPGSPAGSPTSTEEGTSTEPSEGSAPGTSTEPSEGSAPGTSESATPESGPGTSTEPSE GSAPGTSESATPESGPGSEPATSGSETPGTSTEPSEGSAPGTSTEPSEGSAPGTS ESATPESGPGTSESATPESGPG (SEQ ID NO.: 858) |
| AE144_3A | SPAGSPTSTEEGTSESATPESGPGSEPATSGSETPGTSESATPESGPGTSTEPSEGSAPGTSTEPSE GSAPGTSTEPSEGSAPGTSTEPSEGSAPGTSESEGSAPGTSTEPSEGSAPGSPAGSPTSTEEGTS TEPSEGSAPG (SEQ ID NO.: 859) |
| AE144_3B | SPAGSPTSTEEGTSESATPESGPGSEPATSGSETPGTSESATPESGPGTSTEPSEGSAPGTSTEPSE GSAPGTSTEPSEGSAPGTSTEPSEGSAPGTSTEPSEGSAPGSPAGSPTSTEEGTS TEPSEGSAPG (SEQ ID NO.: 860) |
| AE144_4A | TSESATPESGPGSEPATSGSETPGTSESATPESGPGSEPATSGSETPGTSESATPESGPGTSTEPSE GSAPGTSESATPESGPGSPAGSPTSTEEGSPAGSPTSTEEGSPAGSPTSTEEGTSESATPESGPGTS TEPSEGSAPG (SEQ ID NO.: 861) |
| AE144_4B | TSESATPESGPGSEPATSGSETPGTSESATPESGPGSEPATSGSETPGTSESATPESGPGTSTEPSE GSAPGTSESATPESGPGSPAGSPTSTEEGSPAGSPTSTEEGSPAGSPTSTEEGTSESATPESGPGTS TEPSEGSAPG (SEQ ID NO.: 862) |
| AE144_5A | TSESATPESGPGSEPATSGSETPGTSESATPESGPGSEPATSGSETPGTSESATPESGPGTSTEPSE GSAPGSPAGSPTSTEEGTSESATPESGPGSEPATSGSETPGTSESATPESGPGSPAGSPTSTEEGSP AGSPTSTEEG (SEQ ID NO.: 863) |
| AE144_6B | TSTEPSEGSAPGTSESATPESGPGTSESATPESGPGTSESATPESGPGSEPATSGSETPGSEPATSG SETPGSPAGSPTSTEEGTSTEPSEGSAPGTSTEPSEGSAPGSEPATSGSETPGTSESATPESGPGTS TEPSEGSAPG (SEQ ID NO.: 864) |
| AE288_1 | GTSESATPESGPGSEPATSGSETPGTSESATPESGPGSEPATSGSETPGTSESATPESGPGTSTEPS EGSAPGSPAGSPTSTEEGTSESATPESGPGSEPATSGSETPGTSESATPESGPGSPAGSPTSTEEGS PAGSPTSTEEGTSTEPSEGSAPGTSESATPESGPGTSESATPESGPGTSESATPESGPGSEPATSGS ETPGSEPATSGSETPGSPAGSPTSTEEGTSTEPSEGSAPGTSTEPSEGSAPGSEPATSGSETPGTSE SATPESGPGTSTEPSEGSAP (SEQ ID NO.: 865) |
| AE288_2 | GSPAGSPTSTEEGTSESATPESGPGSEPATSGSETPGTSESATPESGPGTSTEPSEGSAPGTSTEPS EGSAPGTSTEPSEGSAPGTSTEPSEGSAPGTSTEPSEGSAPGTSTEPSEGSAPGSPAGSPTSTEEGT STEPSEGSAPGTSESATPESGPGSEPATSGSETPGTSESATPESGPGSEPATSGSETPGTSESATPE SGPGTSTEPSEGSAPGTSESATPESGPGSPAGSPTSTEEGSPAGSPTSTEEGTSE SATPESGPGTSTEPSEGSAP (SEQ ID NO.: 866) |
| AE576 | GSPAGSPTSTEEGTSESATPESGPGTSTEPSEGSAPGSPAGSPTSTEEGTSTEPSEGSAPGTSTEPS EGSAPGTSESATPESGPGSEPATSGSETPGSEPATSGSETPGSPAGSPTSTEEGTSESATPESGPGT STEPSEGSAPGTSTEPSEGSAPGSPAGSPTSTEEGTSTEPSEGSAPGTSTEPSEGSAPGTSESATPE SGPGTSTEPSEGSAPGTSESATPESGPGSEPATSGSETPGTSTEPSEGSAPGTSTEPSEGSAPGTSE SATPESGPGTSESATPESGPGSPAGSPTSTEEGTSESATPESGPGSEPATSGSETPGTSESATPESG PGTSTEPSEGSAPGTSTEPSEGSAPGTSTEPSEGSAPGTSTEPSEGSAPGTSTEP SEGSAPGSPAGSPTSTEEGTSTEPSEGSAPGTSESATPESGPGSEPATSGSETPGTSESATPESGPG SEPATSGSETPGTSESATPESGPGTSTEPSEGSAPGTSESATPESGPGSPAGSPTSTEEGSPAGSPT STEEGSPAGSPTSTEEGTSESATPESGPGTSTEPSEGSAP (SEQ ID NO.: 867) |
| AE624 | MAEPAGSPTSTEEGTPGSGTASSSPGSSTPSGATGSPGASPGTSSTGSPGSPAGSPTSTEEGTSESA TPESGPGTSTEPSEGSAPGSPAGSPTSTEEGTSTEPSEGSAPGTSTEPSEGSAPGTSESATPESGPG SEPATSGSETPGSEPATSGSETPGSPAGSPTSTEEGTSESATPESGPGTSTEPSEGSAPGTSTEPSE GSAPGSPAGSPTSTEEGTSTEPSEGSAPGTSTEPSEGSAPGTSTEPSEGSAPGTSTEPSEGSAPGTS ESATPESGPGSEPATSGSETPGTSTEPSEGSAPGTSTEPSEGSAPGTSESATPESGPGTSESATPES GPGSPAGSPTSTEEGTSESATPESGPGSEPATSGSETPGTSESATPESGPGTSTEPSEGSAPGTSTE PSEGSAPGTSTEPSEGSAPGTSTEPSEGSAPGTSTEPSEGSAPGSPAGSPTSTEE GTSTEPSEGSAPGTSESATPESGPGSEPATSGSETPGTSESATPESGPGTSESAT PESGPGTSTEPSEGSAPGTSESATPESGPGSPAGSPTSTEEGSPAGSPTSTEEGTSE SESATPESGPGTSTEPSEGSAP (SEQ ID NO.: 868) |
| AE864 | GSPAGSPTSTEEGTSESATPESGPGTSTEPSEGSAPGSPAGSPTSTEEGTSTEPSEGSAPGTSTEPS EGSAPGTSESATPESGPGSEPATSGSETPGSEPATSGSETPGSPAGSPTSTEEGTSESATPESGPGT |

TABLE 8-continued

XTEN Polypeptides

| XTEN Name | Amino Acid Sequence |
|---|---|
| | STEPSEGSAPGTSTEPSEGSAPGSPAGSPTSTEEGTSTEPSEGSAPGTSTEPSEGSAPGTSESATPE<br>SGPGTSTEPSEGSAPGTSESATPESGPGSEPATSGSETPGTSTEPSEGSAPGTSTEPSEGSAPGTSE<br>SATPESGPGTSESATPESGPGSPAGSPTSTEEGTSESATPESGPGSEPATSGSETPGTSESATPESG<br>PGTSTEPSEGSAPGTSTEPSEGSAPGTSTEPSEGSAPGTSTEPSEGSAPGTSTEPSEGSAPGTSTEP<br>SEGSAPGSPAGSPTSTEEGTSTEPSEGSAPGTSESATPESGPGSEPATSGSETPGTSESATPESGPG<br>SEPATSGSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPGTSESATPESGPGSEPATSGSETPGTS<br>ESATPESGPGSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSEGSAPGTSES<br>ATPESGPGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAP<br>(SEQ ID NO.: 869) |
| AE865 | GGSPAGSPTSTEEGTSESATPESGPGTSTEPSEGSAPGSPAGSPTSTEEGTSTEPSEGSAPGTSTEP<br>SEGSAPGTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGTSESATP<br>ESGPGTSTEPSEGSAPGTSESATPESGPGSEPATSGSETPGTSTEPSEGSAPGTSTEPSEGSAPGTS<br>ESATPESGPGTSESATPESGPGSPAGSPTSTEEGTSESATPESGPGSEPATSGSETPGTSESATPES<br>GPGTSTEPSEGSAPGTSTEPSEGSAPGTSTEPSEGSAPGTSTEPSEGSAPGTSTEPSEGSAPGTSTE<br>PSEGSAPGSPAGSPTSTEEGTSTEPSEGSAPGTSESATPESGPGSEPATSGSETPGTSESATPESGP<br>GSEPATSGSETPGTSESATPESGPGTSTEPSEGSAPGTSESATPESGPGSPAGSPTSTEEGSPAGSP<br>TSTEEGSPAGSPTSTEEGTSESATPESGPGTSTEPSEGSAPGTSESATPESGPGSEPATSGSETPGT<br>SESATPESGPGSEPATSGSETPGTSESATPESGPGTSTEPSEGSAPGSPAGSPTSTEEGTSESATPE<br>SGPGSEPATSGSETPGTSESATPESGPGSPAGSPTSTEEGSPAGSPTSTEEGTSTEPSEGSAPGTSE<br>SATPESGPGTSESATPESGPGTSESATPESGPGSEPATSGSETPGSEPATSGSETPGSPAGSPTSTE<br>EGTSTEPSEGSAPGTSTEPSEGSAPGSEPATSGSETPGTSESATPESGPGTSTEPSEGSAP<br>(SEQ ID NO.: 870) |
| AE866 | PGSPAGSPTSTEEGTSESATPESGPGTSTEPSEGSAPGSPAGSPTSTEEGTSTEPSEGSAPGTSTEP<br>SEGSAPGTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGTSESATP<br>ESGPGTSTEPSEGSAPGTSESATPESGPGSEPATSGSETPGTSTEPSEGSAPGTSTEPSEGSAPGTS<br>ESATPESGPGTSESATPESGPGSPAGSPTSTEEGTSESATPESGPGSEPATSGSETPGTSESATPES<br>GPGTSTEPSEGSAPGTSTEPSEGSAPGTSTEPSEGSAPGTSTEPSEGSAPGTSTEPSEGSAPGTSTE<br>PSEGSAPGSPAGSPTSTEEGTSTEPSEGSAPGTSESATPESGPGSEPATSGSETPGTSESATPESGP<br>GSEPATSGSETPGTSESATPESGPGTSTEPSEGSAPGTSESATPESGPGSPAGSPTSTEEGSPAGSP<br>TSTEEGSPAGSPTSTEEGTSESATPESGPGTSTEPSEGSAPGTSESATPESGPGSEPATSGSETPGT<br>SESATPESGPGSEPATSGSETPGTSESATPESGPGTSTEPSEGSAPGSPAGSPTSTEEGTSESATPE<br>SGPGSEPATSGSETPGTSESATPESGPGSPAGSPTSTEEGSPAGSPTSTEEGTSTEPSEGSAPGTSE<br>SATPESGPGTSESATPESGPGTSESATPESGPGSEPATSGSETPGSEPATSGSETPGSPAGSPTSTE<br>EGTSTEPSEGSAPGTSTEPSEGSAPGSEPATSGSETPGTSESATPESGPGTSTEPSEGSAPG<br>(SEQ ID NO.: 871) |
| AE1152 | GSPAGSPTSTEEGTSESATPESGPGTSTEPSEGSAPGSPAGSPTSTEEGTSTEPSEGSAPGTSTEPS<br>EGSAPGTSESATPESGPGSEPATSGSETPGSEPATSGSETPGSPAGSPTSTEEGTSESATPESGPGT<br>STEPSEGSAPGTSTEPSEGSAPGSPAGSPTSTEEGTSTEPSEGSAPGTSTEPSEGSAPGTSESATPE<br>SGPGTSTEPSEGSAPGTSESATPESGPGSEPATSGSETPGTSTEPSEGSAPGTSTEPSEGSAPGTSE<br>SATPESGPGTSESATPESGPGSPAGSPTSTEEGTSESATPESGPGSEPATSGSETPGTSESATPESG<br>PGTSTEPSEGSAPGTSTEPSEGSAPGTSTEPSEGSAPGTSTEPSEGSAPGTSTEPSEGSAPGTSTEP<br>SEGSAPGSPAGSPTSTEEGTSTEPSEGSAPGTSESATPESGPGSEPATSGSETPGTSESATPESGPG<br>SEPATSGSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPGTSESATPESGPGSEPATSGSETPGTS<br>ESATPESGPGSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSEGSAPGTSES<br>ATPESGPGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPSEGSAPGTSESAT<br>PESGPGSEPATSGSETPGTSESATPESGPGSEPATSGSETPGTSESATPESGPGTSTEPSEGSAPGS<br>PAGSPTSTEEGTSESATPESGPGSEPATSGSETPGSEPATSGSETPGSPAGSPTSTEEGSPAGSPTS<br>TEEGTSTEPSEGSAPGTSESATPESGPGTSESATPESGPGTSESATPESGPGSEPATSGSETPGSEP<br>ATSGSETPGSPAGSPTSTEEGTSTEPSEGSAPGTSTEPSEGSAPGSEPATSGSETPGTSESATPESG<br>PGTSTEPSEGSAP (SEQ ID NO.: 872) |
| AE144A | STEPSEGSAPGSPAGSPTSTEEGTSTEPSEGSAPGTSESATPESGPGSEPATSGSETPGTSESATPE<br>SGPGSEPATSGSETPGTSESATPESGPGTSTEPSEGSAPGTSESATPESGPGSPAGSPTSTEEGSPA<br>GSPTSTEEGS (SEQ ID NO.: 873) |
| AE144B | SEPATSGSETPGTSESATPESGPGSEPATSGSETPGTSESATPESGPGTSTEPSEGSAPGSPAGSPT<br>STEEGTSESATPESGPGSEPATSGSETPGTSESATPESGPGSPAGSPTSTEEGSPAGSPTSTEEGTS<br>TEPSEGSAPG (SEQ ID NO.: 874) |
| AE180A | TSTEEGTSESATPESGPGSEPATSGSETPGTSESATPESGPGSPAGSPTSTEEGSPAGSPTSTEEGT<br>STEPSEGSAPGTSESATPESGPGTSESATPESGPGTSESATPESGPGSEPATSGSETPGSEPATSGS<br>ETPGSPAGSPTSTEEGTSTEPSEGSAPGTSTEPSEGSAPGSEPATS (SEQ ID NO.: 875) |

TABLE 8-continued

XTEN Polypeptides

| XTEN Name | Amino Acid Sequence |
|---|---|
| AE216A | PESGPGTSTEPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGPGTSESATPE SGPGSEPATSGSETPGSEPATSGSETPGSPAGSPTSTEEGTSTEPSEGSAPGTSTEPSEGSAPGSEP ATSGSETPGTSESAT (SEQ ID NO.: 876) |
| AE252A | ESGPGSEPATSGSETPGTSESATPESGPGTSTEPSEGSAPGSPAGSPTSTEEGTSESATPESGPGSE PATSGSETPGTSESATPESGPGSPAGSPTSTEEGSPAGSPTSTEEGTSTEPSEGSAPGTSESATPES GPGTSESATPESGPGTSESATPESGPGSEPATSGSETPGSEPATSGSETPGSPAGSPTSTEEGTSTE PSEGSAPGTSTEPSEGSAPGSEPATSGSETPGTSESATPESGPGTSTEPSE (SEQ ID NO.: 877) |
| AE288A | TPESGPGTSTEPSEGSAPGTSESATPESGPGSEPATSGSETPGTSESATPESGPGSEPATSGSETPG TSESATPESGPGTSTEPSEGSAPGSPAGSPTSTEEGTSESATPESGPGSEPATSGSETPGTSESATP ESGPGSPAGSPTSTEEGSPAGSPTSTEEGTSTEPSEGSAPGTSESATPESGPGTSESATPESGPGTS ESATPESGPGSEPATSGSETPGSEPATSGSETPGSPAGSPTSTEEGTSTEPSEGSAPGTSTEPSEGS APGSEPATSGSETPGTSESA (SEQ ID NO.: 878) |
| AE324A | PESGPGSPAGSPTSTEEGSPAGSPTSTEEGSPAGSPTSTEEGTSESATPESGPGTSTEPSEGSAPGT SESATPESGPGSEPATSGSETPGTSESATPESGPGSEPATSGSETPGTSESATPESGPGTSTEPSEG SAPGSPAGSPTSTEEGTSESATPESGPGSEPATSGSETPGTSESATPESGPGSPAGSPTSTEEGSPA GSPTSTEEGTSTEPSEGSAPGTSESATPESGPGTSESATPESGPGTSESATPESGPGSEPATSGSET PGSEPATSGSETPGSPAGSPTSTEEGTSTEPSEGSAPGTSTEPSEGSAPGSEPATS (SEQ ID NO.: 879) |
| AE360A | PESGPGTSTEPSEGSAPGTSESATPESGPGSPAGSPTSTEEGSPAGSPTSTEEGSPAGSPTSTEEGT SESATPESGPGTSTEPSEGSAPGTSESATPESGPGSEPATSGSETPGTSESATPESGPGSEPATSGS ETPGTSESATPESGPGTSTEPSEGSAPGSPAGSPTSTEEGTSESATPESGPGSEPATSGSETPGTSE SATPESGPGSPAGSPTSTEEGSPAGSPTSTEEGTSTEPSEGSAPGTSESATPESGPGTSESATPESG PGTSESATPESGPGSEPATSGSETPGSEPATSGSETPGSPAGSPTSTEEGTSTEPSEGSAPGTSTEP SEGSAPGSEPATSGSETPGTSESAT (SEQ ID NO.: 880) |
| AE396A | PESGPGSEPATSGSETPGTSESATPESGPGTSTEPSEGSAPGTSESATPESGPGSPAGSPTSTEEGS PAGSPTSTEEGSPAGSPTSTEEGTSESATPESGPGTSTEPSEGSAPGTSESATPESGPGSEPATSGS ETPGTSESATPESGPGSEPATSGSETPGTSESATPESGPGTSTEPSEGSAPGSPAGSPTSTEEGTSE SATPESGPGSEPATSGSETPGTSESATPESGPGSPAGSPTSTEEGSPAGSPTSTEEGTSTEPSEGSA PGTSESATPESGPGTSESATPESGPGTSESATPESGPGSEPATSGSETPGSEPATSGSETPGSPAGS PTSTEEGTSTEPSEGSAPGTSTEPS (SEQ ID NO.: 881) |
| AE432A | EGSAPGSPAGSPTSTEEGTSTEPSEGSAPGTSESATPESGPGSEPATSGSETPGTSESATPESGPGS EPATSGSETPGTSESATPESGPGTSTEPSEGSAPGTSESATPESGPGSPAGSPTSTEEGSPAGSPTS TEEGSPAGSPTSTEEGTSESATPESGPGTSTEPSEGSAPGTSESATPESGPGSEPATSGSETPGTSE SATPESGPGSEPATSGSETPGTSESATPESGPGTSTEPSEGSAPGSPAGSPTSTEEGTSESATPESG PGSEPATSGSETPGTSESATPESGPGSPAGSPTSTEEGSPAGSPTSTEEGTSTEPSEGSAPGTSESA TPESGPGTSESATPESGPGTSESATPESGPGSEPATSGSETPGSEPATSGSETPGSPAGSPTSTEEG TSTEPSEGSAPGTSTEPSEGSAPGSEPATS (SEQ ID NO.: 882) |
| AE468A | EGSAPGTSTEPSEGSAPGTSTEPSEGSAPGSPAGSPTSTEEGTSTEPSEGSAPGTSESATPESGPGS EPATSGSETPGTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEPSEGSAPGTSE SATPESGPGSEPATSGSETPGTSESATPESGPGSEPATSGSETPGTSESATPESGPGTSTEPSEGSA PGSPAGSPTSTEEGTSESATPESGPGSEPATSGSETPGTSESATPESGPGSPAGSPTSTEEGSPAGS PTSTEEGTSTEPSEGSAPGTSESATPESGPGTSESATPESGPGTSESATPESGPGSEPATSGSETPG SEPATSGSETPGSPAGSPTSTEEGTSTEPSEGSAPGTSTEPSEGSAPGSEPATSGSETPGTSESAT (SEQ ID NO.: 883) |
| AE504A | EGSAPGTSTEPSEGSAPGTSTEPSEGSAPGTSTEPSEGSAPGTSTEPSEGSAPGSPAGSPTSTEEGT STEPSEGSAPGTSESATPESGPGSEPATSGSETPGTSESATPESGPGSEPATSGSETPGTSESATPE SGPGTSTEPSEGSAPGTSESATPESGPGSPAGSPTSTEEGSPAGSPTSTEEGSPAGSPTSTEEGTSE SATPESGPGTSTEPSEGSAPGTSESATPESGPGSEPATSGSETPGTSESATPESGPGSEPATSGSET PGTSESATPESGPGTSTEPSEGSAPGSPAGSPTSTEEGTSESATPESGPGSEPATSGSETPGTSESA TPESGPGSPAGSPTSTEEGSPAGSPTSTEEGTSTEPSEGSAPGTSESATPESGPGTSESATPESGPG TSESATPESGPGSEPATSGSETPGSEPATSGSETPGSPAGSPTSTEEGTSTEPSEGSAPGTSTEPSE GSAPGSEPATSGSETPGTSESATPESGPGTSTEPS (SEQ ID NO.: 884) |
| AE540A | TPESGPGSPAGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAPGSPAGSPT STEEGTSTEPSEGSAPGTSESATPESGPGSEPATSGSETPGTSESATPESGPGSEPATSGSETPGTS ESATPESGPGTSTEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSESATPESGPGSEPA TSGSETPGTSESATPESGPGTSTEPSEGSAPGSPAGSPTSTEEGTSESATPESGPGSEPATSGSETP GTSESATPESGPGSPAGSPTSTEEGSPAGSPTSTEEGTSTEPSEGSAPGTSESATPESGPGTSESAT PESGPGTSESATPESGPGSEPATSGSETPGSEPATSGSETPGSPAGSPTSTEEGTSTEPSEGSAPGT STEP (SEQ ID NO.: 885) |

TABLE 8-continued

XTEN Polypeptides

| XTEN Name | Amino Acid Sequence |
|---|---|
| AE576A | TPESGPGTSESATPESGPGSPAGSPTSTEEGTSESATPESGPGSEPATSGSETPGTSESATPESGPG<br>TSTEPSEGSAPGTSTEPSEGSAPGTSTEPSEGSAPGTSTEPSEGSAPGTSTEPSEGSAPGTSTEPSE<br>GSAPGSPAGSPTSTEEGTSTEPSEGSAPGTSESATPESGPGSEPATSGSETPGTSESATPESGPGSE<br>PATSGSETPGTSESATPESGPGTSTEPSEGSAPGTSESATPESGPGSPAGSPTSTEEGSPAGSPTST<br>EEGSPAGSPTSTEEGTSESATPESGPGTSTEPSEGSAPGTSESATPESGPGSEPATSGSETPGTSES<br>ATPESGPGSEPATSGSETPGTSESATPESGPGTSTEPSEGSAPGSPAGSPTSTEEGTSESATPESGP<br>GSEPATSGSETPGTSESATPESGPGSPAGSPTSTEEGSPAGSPTSTEEGTSTEPSEGSAPGTSESAT<br>PESGPGTSESATPESGPGTSESATPESGPGSEPATSGSETPGSEPATSGSETPGSPAGSPTSTEEGT<br>STEPSEGSAPGTSTEPSEGSAPGSEPATSGSETPGTSESA (SEQ ID NO.: 886) |
| AE612A | GSETPGTSTEPSEGSAPGTSTEPSEGSAPGTSESATPESGPGTSESATPESGPGSPAGSPTSTEEGT<br>SESATPESGPGSEPATSGSETPGTSESATPESGPGTSTEPSEGSAPGTSTEPSEGSAPGTSTEPSEG<br>SAPGTSTEPSEGSAPGTSTEPSEGSAPGTSTEPSEGSAPGSPAGSPTSTEEGTSTEPSEGSAPGTSE<br>SATPESGPGSEPATSGSETPGTSESATPESGPGSEPATSGSETPGTSESATPESGPGTSTEPSEGSA<br>PGTSESATPESGPGSPAGSPTSTEEGSPAGSPTSTEEGTSESATPESGPGTSTEP<br>SEGSAPGTSESATPESGPGSEPATSGSETPGTSESATPESGPGSEPATSGSETPGTSESATPESGPG<br>TSTEPSEGSAPGSPAGSPTSTEEGTSESATPESGPGSEPATSGSETPGTSESATPESGPGSPAGSPT<br>STEEGSPAGSPTSTEEGTSTEPSEGSAPGTSESATPESGPGTSESATPESGPGTSESATPESGPGSE<br>PATSGSETPGSEPATSGSETPGSPAGSPTSTEEGTSTEPSEGSAPGTSTEPSEGSAPGSEPATSGSE<br>TPGTSESAT (SEQ ID NO.: 887) |
| AE648A | PESGPGTSTEPSEGSAPGTSESATPESGPGSEPATSGSETPGTSTEPSEGSAPGTSTEPSEGSAPGT<br>SESATPESGPGTSESATPESGPGSPAGSPTSTEEGTSESATPESGPGSEPATSGSETPGTSESATPE<br>SGPGTSTEPSEGSAPGTSTEPSEGSAPGTSTEPSEGSAPGTSTEPSEGSAPGTSTEPSEGSAPGTST<br>EPSEGSAPGSPAGSPTSTEEGTSTEPSEGSAPGTSESATPESGPGSEPATSGSETPGTSESATPESG<br>PGSEPATSGSETPGTSESATPESGPGTSTEPSEGSAPGTSESATPESGPGSPAGSPTSTEEGSPAGS<br>PTSTEEGSPAGSPTSTEEGTSESATPESGPGTSTEPSEGSAPGTSESATPESGPGSPAGSPGSETPG<br>TSESATPESGPGSEPATSGSETPGTSESATPESGPGTSTEPSEGSAPGSPAGSPTSTEEGTSESATP<br>ESGPGSEPATSGSETPGTSESATPESGPGSPAGSPTSTEEGSPAGSPTSTEEGTSTEPSEGSAPGTS<br>ESATPESGPGTSESATPESGPGTSESATPESGPGSEPATSGSETPGSEPATSGSETPGSPAGSPTST<br>EEGTSTEPSEGSAPGTSTEPSEGSAPGSEPATSGSETPGTSESAT (SEQ ID NO.: 888) |
| AE684A | EGSAPGSPAGSPTSTEEGTSTEPSEGSAPGTSTEPSEGSAPGTSESATPESGPGTSTEPSEGSAPGT<br>SESATPESGPGSEPATSGSETPGTSTEPSEGSAPGTSTEPSEGSAPGTSESATPESGPGTSESATPE<br>SGPGSPAGSPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGSPAGSPTSTE<br>EGTSTEPSEGSAPGTSESATPESGPGSEPATSGSETPGTSESATPESGPGSEPATSGSETPGTSESA<br>TPESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPATSG<br>SETPGTSESATPESGPGTSTEPSEGSAPGSPAGSPTSTEEGTSESATPESGPGSEPATSGSETPGTS<br>ESATPESGPGSPAGSPTSTEEGSPAGSPTSTEEGTSTEPSEGSAPGTSESATPESGPGTSESATPES<br>GPGTSESATPESGPGSEPATSGSETPGSEPATSGSETPGSPAGSPTSTEEGTSTEPSEGSAPGTSTE<br>PSEGSAPGSEPATS (SEQ ID NO.: 889) |
| AE720A | TSGSETPGSEPATSGSETPGSPAGSPTSTEEGTSESATPESGPGTSTEPSEGSAPGTSTEPSEGSAP<br>GSPAGSPTSTEEGTSTEPSEGSAPGTSTEPSEGSAPGTSESATPESGPGTSTEPSEGSAPGTSESAT<br>PESGPGSEPATSGSETPGTSTEPSEGSAPGTSTEPSEGSAPGTSESATPESGPGTSESATPESGPGS<br>PAGSPTSTEEGTSESATPESGPGSEPATSGSETPGTSESATPESGPGTSTEPSEGSAPGTSTEPSEG<br>SAPGTSTEPSEGSAPGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPESG<br>PGTSTEPSEGSAPGTSESATPESGPGSPAGSPTSTEEGSPAGSPTSTEEGSPAGSPTSTEEGTSESA<br>TPESGPGTSTEPSEGSAPGTSESATPESGPGSEPATSGSETPGSEPATSGSETPG<br>TSESATPESGPGTSTEPSEGSAPGSPAGSPTSTEEGTSESATPESGPGSEPATSGSETPGTSESATP<br>ESGPGSPAGSPTSTEEGSPAGSPTSTEEGTSTEPSEGSAPGTSESATPESGPGTSESATPESGPGTS<br>ESATPESGPGSEPATSGSETPGSEPATSGSETPGSPAGSPTSTEEGTSTE<br>(SEQ ID NO.: 890) |
| AE756A | TSGSETPGSEPATSGSETPGSPAGSPTSTEEGTSESATPESGPGTSTEPSEGSAPGTSTEPSEGSAP<br>GSPAGSPTSTEEGTSTEPSEGSAPGTSTEPSEGSAPGTSESATPESGPGTSTEPSEGSAPGTSESAT<br>PESGPGSEPATSGSETPGTSTEPSEGSAPGTSTEPSEGSAPGTSESATPESGPGTSESATPESGPGS<br>PAGSPTSTEEGTSESATPESGPGSEPATSGSETPGTSESATPESGPGTSTEPSEGSAPGTSTEPSEG<br>SAPGTSTEPSEGSAPGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPESG<br>PGTSTEPSEGSAPGTSESATPESGPGSPAGSPTSTEEGSPAGSPTSTEEGSPAGSPTSTEEGTSESA<br>TPESGPGTSTEPSEGSAPGTSESATPESGPGSEPATSGSETPGTSESATPESGPGSEPATSGSETPG<br>TSESATPESGPGTSTEPSEGSAPGSPAGSPTSTEEGTSESATPESGPGSEPATSGSETPGTSESATP<br>ESGPGSPAGSPTSTEEGSPAGSPTSTEEGTSTEPSEGSAPGTSESATPESGPGTSESATPESGPGTS<br>ESATPESGPGSEPATSGSETPGSEPATSGSETPGSPAGSPTSTEEGTSTEPSEGSAPGTSTEPSEGS<br>APGSEPATSGSETPGTSES (SEQ ID NO.: 891) |
| AE792A | EGSAPGTSESATPESGPGSEPATSGSETPGSEPATSGSETPGSPAGSPTSTEEGTSESATPESGPGT<br>STEPSEGSAPGTSTEPSEGSAPGSPAGSPTSTEEGTSTEPSEGSAPGTSTEPSEGSAPGTSESATPE<br>SGPGTSTEPSEGSAPGTSESATPESGPGSEPATSGSETPGTSTEPSEGSAPGTSTEPSEGSAPGTSE<br>SATPESGPGTSESATPESGPGSPAGSPTSTEEGTSESATPESGPGSEPATSGSETPGTSESATPESG |

TABLE 8-continued

XTEN Polypeptides

| XTEN Name | Amino Acid Sequence |
|---|---|
| | PGTSTEPSEGSAPGTSTEPSEGSAPGTSTEPSEGSAPGTSTEPSEGSAPGTSTEP<br>SEGSAPGSPAGSPTSEEGTSTEPSEGSAPGTSESATPESGPGSEPATSGSETPGTSESATPESGPG<br>SEPATSGSETPGTSESATPESGPGTSTEPSEGSAPGTSESATPESGPGSPAGSPTSTEEGSPAGSPT<br>STEEGSPAGSPTSTEEGTSESATPESGPGTSTEPSEGSAPGTSESATPESGPGSEPATSGSETPGTS<br>ESATPESGPGSEPATSGSETPGTSESATPESGPGTSTEPSEGSAPGSPAGSPTSTEEGSESATPES<br>GPGSEPATSGSETPGTSESATPESGPGSPAGSPTSTEEGSPAGSPTSTEEGTSTEPSEGSAPGTSES<br>ATPESGPGTSESATPESGPGTSESATPESGPGSEPATSGSETPGSEPATSGSETPGSPAGSPTSTEE<br>GTSTEPSEGSAPGTSTEPSEGSAPGSEPATSGSETPGTSESATPESGPGTSTEPS<br>(SEQ ID NO.: 892) |
| AE828A | PESGPGTSTEPSEGSAPGSPAGSPTSTEEGTSTEPSEGSAPGTSTEPSEGSAPGTSESATPESGPGS<br>EPATSGSETPGSEPATSGSETPGSPAGSPTSTEEGTSESATPESGPGTSTEPSEGSAPGTSTEPSEG<br>SAPGSPAGSPTSTEEGTSTEPSEGSAPGTSTEPSEGSAPGTSESATPESGPGTSTEPSEGSAPGTSE<br>SATPESGPGSEPATSGSETPGTSTEPSEGSAPGTSTEPSEGSAPGTSESATPESGPGTSESATPESG<br>PGSPAGSPTSTEEGTSESATPESGPGSEPATSGSETPGTSESATPESGPGTSTEPSEGSAPGTSTEP<br>SEGSAPGTSTEPSEGSAPGTSTEPSEGSAPGTSTEPSEGSAPGSPAGSPTSTEEG<br>TSTEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEGTS<br>ESATPESGPGTSTEPSEGSAPGTSESATPESGPGSEPATSGSETPGTSESATPESGPGSEPATSGSE<br>TPGTSESATPESGPGTSTEPSEGSAPGSPAGSPTSTEEGSEPATSGSETPGTSES<br>ATPESGPGSPAGSPTSTEEGSPAGSPTSTEEGTSTEPSEGSAPGTSESATPESGPGTSESATPESGP<br>GTSESATPESGPGSEPATSGSETPGSEPATSGSETPGSPAGSPTSTEEGTSTEPSEGSAPGTSTEPS<br>EGSAPGSEPATSGSETPGTSESAT (SEQ ID NO.: 893) |
| AE869 | GSPGSPAGSPTSTEEGTSESATPESGPGTSTEPSEGSAPGSPAGSPTSTEEGTSTEPSEGSAPGTST<br>EPSEGSAPGTSESATPESGPGSEPATSGSETPGSEPATSGSETPGSPAGSPTSTEEGTSESATPESG<br>PGTSTEPSEGSAPGTSTEPSEGSAPGSPAGSPTSTEEGTSTEPSEGSAPGTSTEPSEGSAPGTSESA<br>TPESGPGTSTEPSEGSAPGTSESATPESGPGSEPATSGSETPGTSTEPSEGSAPGTSTEPSEGSAPG<br>TSESATPESGPGTSESATPESGPGSPAGSPTSTEEGSESATPESGPGSEPATSGSETPGTSESATP<br>ESGPGTSTEPSEGSAPGTSTEPSEGSAPGTSTEPSEGSAPGTSTEPSEGSAPGTSTEPSEGSAPGTS<br>TEPSEGSAPGSPAGSPTSTEEGTSTEPSEGSAPGTSESATPESGPGSEPATSGSETPGTSESATPES<br>GPGSEPATSGSETPGTSESATPESGPGTSTEPSEGSAPGTSESATPESGPGSPAGSPTSTEEGSPAG<br>SPTSTEEGSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSESAT<br>PESGPGSEPATSGSETPGTSESATPESGPGSPAGSPTSTEEGSPAGSPTSTEEGTSTEPSEGSAPGT<br>SESATPESGPGTSESATPESGPGTSESATPESGPGSEPATSGSETPGSEPATSGSETPGSPAGSPTS<br>TEEGTSTEPSEGSAPGSEPATSGSETPGTSESATPESGPGTSTEPSEGSAPGR<br>(SEQ ID NO.: 894) |
| AE144_R1 | SAGSPGSPAGSPTSTEEGTSESATPESGPGTSTEPSEGSAPGSPAGSPTSTEEGTSTEPSEGSAPGT<br>STEPSEGSAPGTSESATPESGPGSEPATSGSETPGSEPATSGSETPGSPAGSPTSTEEGTSESATPE<br>SGPGTESASR (SEQ ID NO.: 895) |
| AE288_R1 | SAGSPTGPGSEPATSGSETPGTSESATPESGPGSEPATSGSETPGTSESATPESGPGTSTEPSEGSA<br>PGSPAGSPTSTEEGTSESATPESGPGSEPATSGSETPGTSESATPESGPGSPAGSPTSTEEGSPAGS<br>PTSTEEGTSTEPSEGSAPGTSESATPESGPGTSESATPESGPGTSESATPESGPGSEPATSGSETPG<br>SEPATSGSETPGSPAGSPTSTEEGTSTEPSEGSAPGTSTEPSEGSAPGSEPATSGSETPGTSESATP<br>ESGPGTSTEPSEGSAPSASR (SEQ ID NO.: 896) |
| AE432_R1 | SAGSPGSPAGSPTSTEEGTSESATPESGPGTSTEPSEGSAPGSPAGSPTSTEEGTSTEPSEGSAPGT<br>STEPSEGSAPGTSESATPESGPGSEPATSGSETPGSEPATSGSETPGSPAGSPTSTEEGTSESATPE<br>SGPGTSTEPSEGSAPGTSTEPSEGSAPGSPAGSPTSTEEGTSTEPSEGSAPGTSTEPSEGSAPGTSE<br>SATPESGPGTSTEPSEGSAPGTSESATPESGPGSEPATSGSETPGTSTEPSEGSAPGTSTEPSEGSA<br>PGTSESATPESGPGTSESATPESGPGSPAGSPTSTEEGSESATPESGPGSEPATSGSETPGTSESA<br>TPESGPGTSTEPSEGSAPGTSTEPSEGSAPGTSTEPSEGSAPGTSTEPSEGSAPGTSTEPSEGSAPG<br>TSTEPSEGSAPGSPAGSPTSTEEGTESASR (SEQ ID NO.: 897) |
| AE576_R1 | SAGSPTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGTSTEPSEGSAPGSPAGSPTSTEEGTSTEP<br>SEGSAPGTSESATPESGPGSEPATSGSETPGTSESATPESGPGSEPATSGSETPGTSESATPESGPG<br>TSTEPSEGSAPGTSESATPESGPGSPAGSPTSTEEGSPAGSPTSTEEGSPAGSPTSTEEGTSESATP<br>ESGPGTSTEPSEGSAPGTSESATPESGPGSEPATSGSETPGSEPATSGSETPGTSESATPESGPGTS<br>ESATPESGPGTSTEPSEGSAPGSPAGSPTSTEEGTSESATPESGPGSEPATSGSETPGTSESATPES<br>GPGSPAGSPTSTEEGSPAGSPTSTEEGTSTEPSEGSAPGTSESATPESGPGTSESATPESGPGTSES<br>ATPESGPGSEPATSGSETPGSEPATSGSETPGSPAGSPTSTEEGTSTEPSEGSAPGTSTEPSEGSAP<br>GSEPATSGSETPGTSESATPESGPGTSTEPSEGSAPSASR (SEQ ID NO.: 898) |
| AE864_R1 | SAGSPGSPAGSPTSTEEGTSESATPESGPGTSTEPSEGSAPGSPAGSPTSTEEGTSTEPSEGSAPGT<br>STEPSEGSAPGTSESATPESGPGSEPATSGSETPGSEPATSGSETPGSPAGSPTSTEEGTSESATPE<br>SGPGTSTEPSEGSAPGTSTEPSEGSAPGSPAGSPTSTEEGTSTEPSEGSAPGTSTEPSEGSAPGTSE<br>SATPESGPGTSTEPSEGSAPGTSESATPESGPGSEPATSGSETPGTSTEPSEGSAPGTSTEPSEGSA<br>PGTSESATPESGPGTSESATPESGPGSPAGSPTSTEEGSESATPESGPGSEPATSGSETPGTSESA<br>TPESGPGTSTEPSEGSAPGTSTEPSEGSAPGTSTEPSEGSAPGTSTEPSEGSAPGTSTEPSEGSAPG<br>TSTEPSEGSAPGSPAGSPTSTEEGTSTEPSEGSAPGTSESATPESGPGSEPATSGSETPGTSESATP<br>ESGPGSEPATSGSETPGTSESATPESGPGTSTEPSEGSAPGTSESATPESGPGSPAGSPTSTEEGSP |

TABLE 8-continued

XTEN Polypeptides

| XTEN Name | Amino Acid Sequence |
|---|---|
| | AGSPTSTEEGSPAGSPTSTEEGTSESATPESGPGTSTEPSEGSAPGTSESATPESGPGSEPATSGSE<br>TPGTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGSAP<br>GTSESATPESGPGTSESATPESGPGTSESATPESGPGSEPATSGSETPGSEPATSGSETPGSPAGSP<br>TSTEEGTSTEPSEGSAPGTSTEPSEGSAPGSEPATSGSETPGTSESATPESGPGTESASR<br>(SEQ ID NO.: 899) |
| AE712 | PGSPAGSPTSTEEGTSESATPESGPGTSTEPSEGSAPGSPAGSPTSTEEGTSTEPSEGSAPGTSTEP<br>SEGSAPGTSESATPESGPGSEPATSGSETPGSEPATSGSETPGSPAGSPTSTEEGTSESATPESGPG<br>TSTEPSEGSAPGTSTEPSEGSAPGSPAGSPTSTEEGTSTEPSEGSAPGTSTEPSEGSAPGTSESATP<br>ESGPGTSTEPSEGSAPGTSESATPESGPGSEPATSGSETPGTSTEPSEGSAPGTSTEPSEGSAPGTS<br>ESATPESGPGTSESATPESGPGSPAGSPTSTEEGTSESATPESGPGSEPATSGSETPGTSESATPES<br>GPGTSTEPSEGSAPGTSTEPSEGSAPGTSTEPSEGSAPGTSTEPSEGSAPGTSTEPSEGSAPGTSTE<br>PSEGSAPGSPAGSPTSTEEGTSTEPSEGSAPGTSESATPESGPGSEPATSGSETPGTSESATPESGP<br>GSEPATSGSETPGTSESATPESGPGTSTEPSEGSAPGTSESATPESGPGSPAGSPTSTEEGSPAGSP<br>TSTEEGSPAGSPTSTEEGTSESATPESGPGTSTEPSEGSAPGTSESATPESGPGSEPATSGSETPGT<br>SESATPESGPGSEPATSGSETPGTSESATPESGPGTSTEPSEGSAPGSPAGSPTSTEEGTSESATPE<br>SGPGSEPATSGSETPGTSESATPESGPGSPAGSPTSTEAHHH (SEQ ID NO.: 900) |
| AE864_R2 | GSPGAGSPAGSPTSTEEGTSESATPESGPGTSTEPSEGSAPGSPAGSPTSTEEGTSTEPSEGSAPGT<br>STEPSEGSAPGTSESATPESGPGSEPATSGSETPGSEPATSGSETPGSPAGSPTSTEEGTSESATPE<br>SGPGTSTEPSEGSAPGTSTEPSEGSAPGSPAGSPTSTEEGTSTEPSEGSAPGTSTEPSEGSAPGTSE<br>SATPESGPGTSTEPSEGSAPGTSESATPESGPGSEPATSGSETPGTSTEPSEGSAPGTSTEPSEGSA<br>PGTSESATPESGPGTSESATPESGPGSPAGSPTSTEEGTSESATPESGPGSEPATSGSETPGTSESA<br>TPESGPGTSTEPSEGSAPGTSTEPSEGSAPGTSTEPSEGSAPGTSTEPSEGSAPGTSTEPSEGSAPG<br>TSTEPSEGSAPGSPAGSPTSTEEGTSTEPSEGSAPGTSESATPESGPGSEPATSGSETPGTSESATP<br>ESGPGSEPATSGSETPGTSESATPESGPGTSTEPSEGSAPGTSESATPESGPGSPAGSPTSTEEGSP<br>AGSPTSTEEGSPAGSPTSTEEGTSESATPESGPGTSTEPSEGSAPGTSESATPESGPGSEPATSGSE<br>TPGTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGSAP<br>GTSESATPESGPGTSESATPESGPGTSESATPESGPGSEPATSGSETPGSEPATSGSETPGSPAGSP<br>TSTEEGTSTEPSEGSAPGTSTEPSEGSAPGSEPATSGSETPGTSESATPESGPGTESASR<br>(SEQ ID NO.: 901) |

The disclosure contemplates compositions comprising XTEN of intermediate lengths to those of Table 8, as well as XTEN of longers lengths in which motifs of 12 amino acids are added to the N- or C- terminus of an XTEN of Table 8 incorporated into the composition. In one embodiment, a subject composition comprises an XTEN of Table 8 with the addition of one or more copies of one or more motifs selected from the group of motifs set forth in Table 9.

TABLE 9

XTEN Sequence Motifs of 12 Amino Acids and Motif Families

| Motif Family* | MOTIF SEQUENCE |
|---|---|
| AD | GESPGGSSGSES (SEQ ID NO.: 902) |
| AD | GSEGSSGPGESS (SEQ ID NO.: 903) |
| AD | GSSESGSSEGGP (SEQ ID NO.: 904) |
| AD | GSGGEPSESGSS (SEQ ID NO.: 905) |
| AE | GSPAGSPTSTEE (SEQ ID NO.: 906) |
| AE | GSEPATSGSETP (SEQ ID NO.: 907) |
| AE | GTSESATPESGP (SEQ ID NO.: 908) |
| AE | GTSTEPSEGSAP (SEQ ID NO.: 909) |
| AF | GSTSESPSGTAP (SEQ ID NO.: 910) |
| AF | GTSTPESGSASP (SEQ ID NO.: 911) |
| AF | GTSPSGESSTAP (SEQ ID NO.: 912) |
| AF | GSTSSTAESPGP (SEQ ID NO.: 913) |
| AG | GTPGSGTASSSP (SEQ ID NO.: 914) |
| AG | GSSTPSGATGSP (SEQ ID NO.: 915) |
| AG | GSSPSASTGTGP (SEQ ID NO.: 916) |
| AG | GASPGTSSTGSP (SEQ ID NO.: 917) |

*Denotes individual motif sequences that, when fused together in various permutations, results in a "family sequence"

In another embodiment, the amino acid sequences for certain XTEN utilized in the embodiments of the disclosure are shown in Table 10. In one embodiment, the AAC comprises a first XTEN (XTEN1) comprising an amino acid sequence having at least about 90%, 91%, 92%, 93%, 94%, 95%, 96%, 97%, 98%, 99%, or 100% sequence identity, when optimally aligned, to a sequence selected from the sequences set forth in Table 10. In other embodiments, the AAC comprises an XTEN1 and a second XTEN (XTEN2) comprising an amino acid sequence having at least about 90%, 91%, 92%, 93%, 94%, 95%, 96%, 97%, 98%, 99%, or 100% sequence identity, when optimally aligned, to a sequence selected from the sequences set forth in Table 10. In one embodiment of the foregoing, the XTEN1 and XTEN2 are identical. In another embodiment of the foregoing, the XTEN1 and XTEN2 are different. In another embodiment, the AAC comprises an XTEN1 and an XTEN2 comprising amino acid sequences having at least about 90%, 91%, 92%, 93%, 94%, 95%, 96%, 97%, 98%, 99%, or 100% sequence identity, when optimally aligned, to a sequence selected from the sequences set forth in Tables 8 and 10. In another embodiment, the AAC comprises an XTEN1 and an XTEN2 comprising amino acid sequences having at least about 90%, 91%, 92%, 93%, 94%, 95%, 96%, 97%, 98%, 99%, or 100% sequence identity, when optimally aligned, to a sequence selected from the sequences set forth in Tables 8 and 10 and further comprising a His tag of HHHHHH or HHHHHHHH at the N-terminus or C-terminus of the composition.

TABLE 10

XTEN Polypeptides

| XTEN Name | Amino Acid Sequence |
|---|---|
| AE288_3 | SPAGSPTSTEEGTSESATPESGPGTSTEPSEGSAPGTSESATPESGPGSEPATSGSETPGTSESATP ESGPGSEPATSGSETPGTSESATPESGPGTSTEPSEGSAPGSPAGSPTSTEEGTSESATPESGPGSE PATSGSETPGTSESATPESGPGSPAGSPTSTEEGSPAGSPTSTEEGTSTEPSEGSAPGTSESATPES GPGTSESATPESGPGTSESATPESGPGSEPATSGSETPGSEPATSGSETPGSPAGSPTSTEEGTSTE PSEGSAPGTSTEPSEGSAPG (SEQ ID NO.: 920) |
| AE284 | GTSESATPESGPGSEPATSGSETPGTSESATPESGPGSEPATSGSETPGTSESATPESGPGTSTEPS EGSAPGSPAGSPTSTEEGTSESATPESGPGSEPATSGSETPGTSESATPESGPGSPAGSPTSTEEGS PAGSPTSTEEGTSTEPSEGSAPGTSESATPESGPGTSESATPESGPGSEPATSGS ETPGSEPATSGSETPGSPAGSPTSTEEGTSTEPSEGSAPGTSTEPSEGSAPGSEPATSGSETPGTSE SATPESGPGTSTEPSE (SEQ ID NO.: 921) |
| AE292 | SPAGSPTSTEEGTSESATPESGPGTSTEPSEGSAPGTSESATPESGPGSEPATSGSETPGTSESATP ESGPGSEPATSGSETPGTSESATPESGPGTSTEPSEGSAPGSPAGSPTSTEEGTSESATPESGPGSE PATSGSETPGTSESATPESGPGSPAGSPTSTEEGSPAGSPTSTEEGTSTEPSEGSAPGTSESATPES GPGTSESATPESGPGTSESATPESGPGSEPATSGSETPGSEPATSGSETPGSPAGSPTSTEEGTSTE PSEGSAPGTSTEPSEGSAPGGSAP (SEQ ID NO.: 922) |
| AE864_2 | AGSPTSTEEGTSESATPESGPGTSTEPSEGSAPGSPAGSPTSTEEGTSTEPSEGSAPGTSTEPSEGS APGTSESATPESGPGSEPATSGSETPGSEPATSGSETPGSPAGSPTSTEEGTSTEPSEGSAPGTSTE PSEGSAPGTSTEPSEGSAPGSPAGSPTSTEEGTSTEPSEGSAPGTSTEPSEGSAPGTSESATPESGP GTSTEPSEGSAPGTSESATPESGPGSEPATSGSETPGTSTEPSEGSAPGTSTEPSEGSAPGTSESAT PESGPGTSESATPESGPGSPAGSPTSTEEGTSESATPESGPGSEPATSGSETPGTSESATPESGPGT STEPSEGSAPGTSTEPSEGSAPGTSTEPSEGSAPGTSTEPSEGSAPGTSESATPESGPGTSTEPSEG SAPGSPAGSPTSTEEGTSTEPSEGSAPGTSTEPSEGSAPGTSESATPESGPGTSTEPSESATPESGPGSEP ATSGSETPGTSESATPESGPGTSTEPSEGSAPGTSESATPESGPGSPAGSPTSTEEGSPAGSPTSTE EGSPAGSPTSTEEGTSESATPESGPGTSTEPSEGSAPGTSESATPESGPGSEPATSGSETPGTSESA TPESGPGSEPATSGSETPGTSESATPESGPGTSTEPSEGSAPGSPAGSPTSTEEGTSESATPESGPG SEPATSGSETPGTSESATPESGPGSPAGSPTSTEEGSPAGSPTSTEEGTSTEPSEGSAPGTSESATP ESGPGTSESATPESGPGTSESATPESGPGSEPATSGSETPGSEPATSGSETPGSPAGSPTSTEEGTS TEPSEGSAPGSEPATSGSETPGTSESATPESGPGTSTEPSEGAAEPEA (SEQ ID NO.: 923) |
| AE867 | GSPAGSPTSTEEGTSESATPESGPGTSTEPSEGSAPGSPAGSPTSTEEGTSTEPSEGSAPGTSTEPS EGSAPGTSESATPESGPGSEPATSGSETPGSEPATSGSETPGSPAGSPTSTEEGTSESATPESGPGT STEPSEGSAPGTSTEPSEGSAPGSPAGSPTSTEEGTSTEPSEGSAPGTSTEPSEGSAPGTSESATPE SGPGTSTEPSEGSAPGTSESATPESGPGSEPATSGSETPGTSTEPSEGSAPGTSTEPSEGSAPGTSE SATPESGPGTSESATPESGPGSPAGSPTSTEEGTSESATPESGPGSEPATSGSETPGTSESATPESG PGTSTEPSEGSAPGTSTEPSEGSAPGTSTEPSEGSAPGTSTEPSEGSAPGTSTEPSEGSAPGTSTEP SEGSAPGSPAGSPTSTEEGTSTEPSEGSAPGTSESATPESGPGSEPATSGSETPGTSESATPESGPG SEPATSGSETPGTSESATPESGPGTSTEPSEGSAPGTSESATPESGPGSPAGSPTSTEEGSPAGSPT STEEGSPAGSPTSTEEGTSESATPESGPGTSTEPSEGSAPGTSESATPESGPGSEPATSGSETPGTS ESATPESGPGSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSEGSAPGTSES ATPESGPGTSESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEGAAEPEA (SEQ ID NO.: 924) |
| AE867_2 | SPGSPAGSPTSTEEGTSESATPESGPGTSTEPSEGSAPGSPAGSPTSTEEGTSTEPSEGSAPGTSTE PSEGSAPGTSESATPESGPGSEPATSGSETPGSEPATSGSETPGSPAGSPTSTEEGTSESATPESGP GTSTEPSEGSAPGTSTEPSEGSAPGSPAGSPTSTEEGTSTEPSEGSAPGTSTEPSEGSAPGTSESAT PESGPGTSTEPSEGSAPGTSESATPESGPGSEPATSGSETPGTSTEPSEGSAPGTSTEPSEGSAPGT SESATPESGPGTSESATPESGPGSPAGSPTSTEEGTSESATPESGPGSEPATSGSETPGTSESATPE SGPGTSTEPSEGSAPGTSTEPSEGSAPGTSTEPSEGSAPGTSTEPSEGSAPGTSTEPSEGSAPGTST EPSEGSAPGSPAGSPTSTEEGTSTEPSEGSAPGTSESATPESGPGSEPATSGSETPGTSESATPESG PGSEPATSGSETPGTSESATPESGPGTSTEPSEGSAPGTSESATPESGPGSPAGSPTSTEEGSPAGS PTSTEEGSPAGSPTSTEEGTSESATPESGPGTSTEPSEGSAPGTSESATPESGPGSEPATSGSETPG TSESATPESGPGSEPATSGSETPGTSESATPESGPGTSTEPSEGSAPGSPAGSPTSTEEGTSESATP ESGPGSEPATSGSETPGTSESATPESGPGSPAGSPTSTEEGSPAGSPTSTEEGTSTEPSEGSAPGTS ESATPESGPGTSESATPESGPGTSESATPESGPGSEPATSGSETPGSEPATSGSETPGSPAGSPTST EEGTSTEPSEGSAPGTSTEPSEGSAPGSEPATSGSETPGTSESATPESGPGTSTEPSEGSAPG (SEQ ID NO.: 925) |
| AE868 | PGSPAGSPTSTEEGTSESATPESGPGTSTEPSEGSAPGSPAGSPTSTEEGTSTEPSEGSAPGTSTEP SEGSAPGTSESATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGSAPGTSESATP ESGPGTSTEPSEGSAPGTSESATPESGPGSEPATSGSETPGTSTEPSEGSAPGTSTEPSEGSAPGTS ESATPESGPGTSESATPESGPGSPAGSPTSTEEGTSESATPESGPGSEPATSGSETPGTSESATPES GPGTSTEPSEGSAPGTSTEPSEGSAPGTSTEPSEGSAPGTSTEPSEGSAPGTSTEPSEGSAPGTSTE PSEGSAPGSPAGSPTSTEEGTSTEPSEGSAPGTSESATPESGPGSEPATSGSETPGTSESATPESGP GSEPATSGSETPGTSESATPESGPGTSTEPSEGSAPGTSESATPESGPGSPAGSPTSTEEGSPAGSP TSTEEGSPAGSPTSTEEGTSESATPESGPGTSTEPSEGSAPGTSESATPESGPGSEPATSGSETPGT |

TABLE 10-continued

XTEN Polypeptides

| XTEN Name | Amino Acid Sequence |
|---|---|
| | SESATPESGPGSEPATSGSETPGTSESATPESGPGTSTEPSEGSAPGSPAGSPTSTEEGTSESATPE SGPGSEPATSGSETPGTSESATPESGPGSPAGSPTSTEEGSPAGSPTSTEEGTSTEPSEGSAPGTSE SATPESGPGTSESATPESGPGTSESATPESGPGSEPATSGSETPGSEPATSGSETPGSPAGSPTSTE EGTSTEPSEGSAPGTSTEPSEGSAPGSEPATSGSETPGTSESATPESGPGTSTEPSEGAAEPEA (SEQ ID NO.: 926) |

Additional examples of XTEN sequences that can be used according to the present disclosure and are disclosed in US Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, WO 2011028344 A2, WO 2014/011819 A2, or WO 2015/023891.

VI. Recombinant Polypeptide and AAC Configurations and Properties

It is an object of the disclosure to provide recombinant polypeptides that are designed and created in an activatable, prodrug form in order to confer certain structural, activity, pharmaceutical and pharmacologic properties. In a property conferred by the design of the recombinant polypeptides, the binding moieties have reduced ability to bind their ligands until the XTEN component of the recombinant polypeptides, which shields the binding moieties and reduces their binding affinity to their ligands, is released from the composition by cleavage of the release segment that fuses the binding moieties to the XTEN.

The design of the subject compositions having a first binding moiety was driven by consideration of at least three properties: 1) compositions having a binding moiety with the capability to bind the desired target cell marker(s) on a target cell; 2) compositions with one or more XTEN that i) shields the binding moiety and reduces binding affinity for the target cell marker when the composition is in an intact form (thus rendering a prodrug form), ii) provides enhanced half-life when administered to a subject, iii) reduces extravasation of the intact composition from the circulation in normal tissues and organs compared to diseased tissues (e.g., tumor), and iv) confers an increased safety profile compared to conventional antibody therapeutics; and 3) is activated when the RS is cleaved by one or more mammalian proteases in proximity of or co-localized with diseased tissues or cells, thereby releasing the binding moiety such that the binding moiety regains its full binding affinity potential for the target ligand. The design of the subject compositions takes advantage of the properties of XTEN and the release segment (RS) components, and their positioning relative to the binding moiety achieves the foregoing properties, as evidenced by the results in the illustrative Examples, below.

In embodiments of recombinant polypeptides having a single binding moiety, a single RS, and a single XTEN, the recombinant polypeptides can have, in an uncleaved state, a structural arrangement from N-terminus to C-terminus of FBM-RS1-XTEN1 or XTEN1-RS1-FBM.

In other embodiments, the disclosure provides recombinant polypeptides having two binding moieties that are antibody fragments and are activatable (referred to as "AAC") with a first binding moiety that targets an effector cell and a second binding moiety that targets a cell marker associated with a disease tissue or cell; both of which have specific binding affinity for their respective ligands. The design of the subject compositions having a first and a second binding moiety (FBM and SBM, respectively) was driven by consideration of at least three properties: 1) compositions having bispecific binding moieties with the capability to bind to and link together an effector cell and a target cell with the resultant formation of an immunological synapse; 2) compositions with a XTEN that i) shields both of the binding moieties and reduces binding affinity for the target and effector cell ligands when the composition is in an intact prodrug form, ii) provides enhanced half-life when administered to a subject, iii) reduces extravasation of the intact composition from the circulation in normal tissues and organs compared to diseased tissues (e.g., tumor), and iv) confers an increased safety profile compared to conventional bispecific cytotoxic antibody therapeutics; and 3) is activated when the RS is cleaved by one or more mammalian proteases in proximity of diseased tissues, thereby releasing the bispecific binding moieties such that they regain their full binding affinity potential for the target ligands. The design of the subject compositions takes advantage of the properties of XTEN and the release segment (RS) components, and their positioning relative to the bispecific binding moieties achieves the foregoing properties, as evidenced by the results in the illustrative Examples, below.

With reference to FIGS. 11 and 12, in exemplary embodiments, the two binding moieties of the AAC are connected to each other by a short linker, and are, in turn, connected to the XTEN by the release segment (RS) peptide that includes up to three different cleavage sites designed to allow separation and release of the binding moieties from the XTEN upon cleavage of any one or all of the cleavage sites. In embodiments of AAC having two binding moieties, a single RS, and a single XTEN, the AAC can have, in an uncleaved state, a structural arrangement from N-terminus to C-terminus of SBM-FBM-RS1-XTEN1, FBM-SBM-RS1-XTEN1, XTEN1-RS1-SBM-FBM, XTEN1-RS1-FBM-SBM, or diabody-RS1-XTEN1, or XTEN1-RS1-diabody, wherein the diabody comprises VL and VH of the FBM and SBM. For the foregoing AAC configurations, and as described above, the FBM has VL and VH derived from antibodies having binding affinity to effector cells, including the antibodies of Table 4, the SBM VL and VH are derived from antibodies having binding affinity to target cell markers, including but not limited to the antibodies of Table 5, the release segments have sequences having 88-100% identity to the sequences of Table 1 or Table 2, and the XTEN have sequences having 90-100% identity to the sequences of Table 8 or Table 10.

In other embodiments, the disclosure provides AAC having two binding moieties, two RS, and two XTEN. The design of these AAC was driven by considerations of further reducing the binding affinity of the uncleaved compositions to the respective ligands of the FBM and SBM antibody fragments by the addition of the second XTEN in order to reduce the unintended binding of the AAC to healthy tissues or cells when administered to a subject, thereby further improving the therapeutic index of the subject compositions compared to AAC having only one RS and one XTEN. As described in the Examples, the addition of the second RS and second XTEN resulted in a suprising reduction of binding affinity of the intact, uncleaved AAC to the respective ligands of the FBM and SBM antibody fragments relative to those AAC having a single RS and XTEN, when assayed in vitro, and also resulted in reduced toxicity in animal models of disease. In embodiments of AAC having a two binding moieties, two RS, and two XTEN, the AAC can have, in an uncleaved state, a structural arrangement from N-terminus to C-terminus of XTEN1-RS1-SBM-FBM-RS2-XTEN2, XTEN1-RS1-FBM-SBM-RS2-XTEN2, XTEN2-RS2-SBM-FBM-RS1-XTEN1, XTEN2-RS2-FBM-SBM-RS1-XTEN1, XTEN2-RS2-diabody-RST-XTEN1, wherein the diabody comprises VL and VH of the FBM and SBM, or XTEN1-RS1-diabody-RS2-XTEN2, wherein the diabody comprises VL and VH of the FBM and SBM. For the foregoing AAC configurations, and as described above, the FBM has VL and VH derived from antibodies having binding affinity to effector cells, including the antibodies of Table 4, the SBM VL and VH are derived from antibodies having binding affinity to target cell markers, including but not limited to the antibodies of Table 5, the release segments have sequences having 88-100% identity to the sequences of Table 1 or Table 2, and the XTEN have sequences having 90-100% identity to the sequences of Table 8 or Table 10.

It is an object of the disclosure that the binding affinity of each binding moiety released from the AAC is greater for the respective target ligands compared to the binding moieties of the intact composition that has not been cleaved, such as when assayed in an in vitro binding assay as described herein. In one embodiment, the binding affinity of the effector cell binding moiety released from the composition by cleavage of the RS by a protease is at least 3-fold, or at least 4-fold, or at least 5-fold, or at least 6-fold, or at least 7-fold, or at least 8-fold, or at least 9-fold, or at least 10-fold, or at least 100-fold, or at least 1000-fold, or at least 10,000-fold greater for the released effector cell antigen compared to the effector cell binding moiety of the intact AAC, as measured in an in vitro cell assay with an effector cell having said effector cell antigen on the cell surface of said cell or in an ELISA with bound effector cell antigen, when assayed under comparable conditions, e.g., equivalent molar concentrations. In one embodiment, the effector cell antigen is CD3. In other embodiments, the binding affinity of the target cell binding moiety released from the composition by cleavage of the RS by a protease is at least 2-fold, or at least 3-fold, or at least 4-fold, or at least 5-fold, or at least 6-fold, or at least 7-fold, or at least 8-fold, or at least 9-fold, or at least 10-fold, or at least 100-fold, or at least 1000-fold or at least 10,000-fold greater for the target marker or target cell antigen compared to the target cell binding moiety of the intact AAC, as measured in an in vitro cell assay with an tumor cell having said antigen on the cell surface of said cell or in an ELISA with bound effector cell antigen, when assayed under comparable conditions, e.g., equivalent molar concentrations. In one embodiment of the foregoing, the target marker or an antigen of a target cell is selected from the group consisting of alpha 4 integrin, Ang2, B7-H3, B7-H6, CEACAM5, cMET, CTLA4, FOLR1,Ep-CAM, CCR5, CD19, HER2, HER2 neu, HER3, HER4, HER1 (EGFR), PD-L1, PSMA, CEA, MUC1(mucin), MUC-2, MUC3, MUC4, MUC5AC, MUC5B, MUC7, MUC16 βhCG, Lewis-Y, CD20, CD33, CD38, CD30, CD56 (NCAM), CD133, ganglioside GD3; 9-O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Muellerian inhibitory substance receptor type II (MISIIR), sialylated Tn antigen (s TN), fibroblast activation antigen (FAP), endosialin (CD248), epidermal growth factor receptor variant III (EGFRvIII), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, and EphA2. It is specifically contemplated in the embodiments of the paragraph that the shielding effect of the XTEN applies to both binding moieties of the foregoing embodiments of the intact, prodrug form of the activatable recombinant polypeptide composition, and that upon release of the XTEN from the AAC by cleavage of the RS, the full binding potential of the respective binding moieties is restored.

Without being bound to a particular theory, it is believed that using the bispecific binding moiety format of the AAC as described above, the released fused FBM and SBM antibody fragments are capable of killing target cells by recruitment of cytotoxic effector cells without any need for pre- and/or co-stimulation. Further, the independence from pre- and/or co-stimulation of the effector cell may substantially contribute to the exceptionally high cytotoxicity mediated by the released binding moieties. In some embodiments, the released FBM is designed with binding specificities such that it has the capability to bind and link together cytotoxic effector cells (e.g., T cells, NK cells, cytokine induced killer cell (CIK cell)), to preselected target cell markers by the SBM (that remains linked to the FBM by a linker peptide) that has binding specificity to target cell markers associated with tumor cells or cancer cells, thereby effecting an immunological synapse and a selective, directed, and localized effect of released cytokines and effector molecules against the target tumor or cancer cell, with the result that tumor or cancer cells are damaged or destroyed, resulting in therapeutic benefit to a subject. In one embodiment, the released FBM that binds to an effector cell antigen is capable of modulating one or more functions of an effector cell, resulting in or contributed to the cytolytic effect on the target tumor cell. The effector cell antigen can by expressed by the effector cell or other cells. In one embodiment, the effector cell antigen is expressed on cell surface of the effector cell. Non-limiting examples are CD3, CD4, CD8, CD16, CD25, CD38, CD45RO, CD56, CD57, CD69, CD95, CD107, and CD154. Thus, it will be understood by one of skill in the art that the configurations of the subject compositions are intended to selectively or disproportionately deliver the active form of the composition to the target tumor tissue or cancer cell, compared to healthy tissue or healthy cells in a subject in which the composition is administered, with resultant therapeutic benefit. As is evident from the foregoing, the disclosure provides a large family of polypeptides in designed configurations to effect the desired properties.

It is an object of the disclosure that the design of the AAC, with the shielding XTEN of the intact AAC and the concomitant reduction in binding to T cells and target tissues, results in reduced production of Th1 T-cell associated cytokines or other proinflammatory mediators during systemic exposure when administered to a subject such that the overall side-effect and safety profile is improved compared to bispecific binding compositions not linked to a bulking moiety such as XTEN. As an important component of cellular immunity, the production of IL-2, TNF-alpha, and IFN-gamma are hallmarks of a Th1 response (Romagnani S. T-cell subsets (Th1 versus Th2). Ann Allergy Asthma Immunol. 2000. 85(1):9-18), particularly in T cells stimulated by anti-CD3 (Yoon, S. H. Selective addition of CXCR3+ CCR4−CD4+ Th1 cells enhances generation of cytotoxic T cells by dendritic cells in vitro. Exp Mol Med. 2009. 41(3):161-170), and Il-4, IL-6, and IL-10 are also proinflammatory cytokines important in a cytotoxic response for bispecific antibody composition (Zimmerman, Z., et al. Unleashing the clinical power of T cells: CD19/CD3 bispecific T cell engager (BiTE®) antibody composition blinatumomab as a potential therapy. Int. Immunol. (2015) 27(1): 31-37). In one embodiment, an intact, uncleaved AAC exhibits at least 3-fold, or at least 4-fold, or at least 5-fold, or at least 6-fold, or at least 7-fold, or at least 8-fold, or at least 9-fold, or at least 10-fold, or at least 20-fold, or at least 30-fold, or at least 50-fold, or at least 100-fold, or at least 1000-fold reduced potential to result in the production of Th1 and/or proinflammatory cytokines when the intact, uncleaved AAC is in contact with the effector cell and a target cell in an in vitro cell-based cytokine stimulation assay (such as described in the Examples, below) compared to the cytokine levels stimulated by the corresponding released first and second binding moieties (which remain linked together after release) of a protease-treated AAC in the in vitro cell-based stimulation cytokine assay performed under comparable conditions, e.g., equivalent molar concentrations. Non-limiting examples of Th1 and/or proinflammatory cytokines are IL-2, IL-4, IL-6, IL-10, TNF-alpha and IFN-gamma. In one embodiment of the foregoing, the production of the Th1 cytokine is assayed in an in vitro assay comprising effector cells such as PBMC or CD3+ T cells and target cells having a tumor specific marker antigen selected from the group consisting of A33 antigen, alpha-fetoprotein (AFP), alpha 4 integrin, Ang2, B7-H3, B7-H6, B-cell maturation antigen (BCMA), cancer antigen 19-9 (CA19-9), cancer antigen 125 (CA-125), Carbonic Anhydrase 6 (CA6), carbonic anhydrase IX (CAIX), CEACAM5, cMET, CTLA4, C-C Motif Chemokine Receptor 1 (CCR1), C-C Motif Chemokine Receptor 2 (CCR2), C-C Motif Chemokine Receptor 3 (CCR3), C-C Motif Chemokine Receptor 4 (CCR4), C-C Motif Chemokine Receptor 5 (CCR5), C-C Motif Chemokine Receptor 6 (CCR6), C-C Motif Chemokine Receptor 7 (CCR7), C-C Motif Chemokine Receptor 8 (CCR8), C-C Motif Chemokine Receptor 9 (CCR9), Cluster of Differentiation 7 (CD7), CD22, CD70, CD79a, CD79b, CD19, CCR8, CEA, βhCG, Lewis-Y, CA19-9, CA-125, CD20, CD22, CD25, CD33, CD38, CD30, CD44v6, CD47, CD56 (NCAM), CD63, CD79b, CD123, CD133, CD138, CD166, claudin-1, claudin 18.2, C-type lectin-like molecule-1 (CLL-1), C-type lectin domain family 12 (CLEC12), Cora antigen, delta like canonical notch ligand 3 (DDL3), desmoglein 4, delta like non-xanonical notch ligand 1 (DLK1), Ectonucleotide Pyrophosphatase/Phosphodiesterase 3 (ENPP3), EGFR, EGFRvIII, EpCAM, endosialin (CD248), epidermal growth factor receptor variant III (EGFRvIII), EphA2, F19 antigen, fetal acetylcholine receptor (fnAChR), fibroblast activation antigen (FAP), Fos-related antigen 1 (FRA1), Folate Receptor 1 (FOLR1), fucosyl GM1, G250, ganglioside GD3, glypican-3 (GPC3), 9-O-Acetyl-GD3, GM2, Glucocorticoid induced TNF receptor (GITR), globohexaosylceramide (globo-H), GD2, Glypican 3 (GPC3), guanylyl cyclase C (GCC), HER2, HER2 neu, HER3, HER4, HER1, IL13Rα2, insulin-like growth factor I receptor (IGF-IR), Lysosomal Associated Membrane Protein 1 (LAMP1), L1 Cell Adhesion Molecule (LiCAM), lymphocyte antigen 6 (Ly-6), melanoma chondroitin sulfate proteoglycan (MCSP), Membrane-type metalloproteinase (MT-MMP), mesothelin, mucin 1 (MUC1), MUC2, MUC3, MUC4, MUC5AC, MUC5B, MUC7, MUC16, Muellerian inhibitory substance receptor type II (MISIIR), nectin cell adhesion molecule 4 (Nectin-4), 6-transmembrane epithelial antigen of prostate (STEAP), plasma cell antigen 1, prostate stem cell antigen (PSCA), Programmed Cell Death 1 (PD1), Programmed death-ligand 1 (PD-L1), PSMA, Receptor Tyrosine Kinase Like Orphan Receptor 1 (ROR1), sialylated Tn antigen (s TN), sodium-dependent phosphate transport protein 2b (NaPi2b), Sonic Hedgehog (Shh), SAS, SLAM Family Member 7 (SLAM7), Somatostatin Receptor 2 (SSTR2), Sperm Autoantigenic Protein 17 (SP17), TAG72, Thomsen-Friedenreich antigen (TF-antigen), tumor-associated antigen L6 (TAL6), trophoblast glycoprotein (5T4), Trop-2, Wue-1, VEGFR1, VEGFR2, and Wilms tumor protein (WT1). In another embodiment of the foregoing, the assayed cytokine is IL-2. In another embodiment of the foregoing, the assayed cytokine is TNF-alpha. In another embodiment of the foregoing, the assayed cytokine is IFN-gamma. In another embodiment, an intact, uncleaved AAC administered to a subject having a tumor with target cell marker that can be bound by the released binding moiety of the AAC exhibits at least 2-fold, at least 3-fold, at least 4-fold, at least 5-fold, at least 6-fold, at least 7-fold, at least 8-fold, at least 9-fold, at least 10-fold, at least 20-fold, at least 30-fold, at least 50-fold, at least 100-fold, or at least 1000-fold reduced potential to result in the systemic production of Th1 and/or proinflammatory cytokines in the subject compared to the cytokine levels produced by the corresponding released binding moieties of a protease-treated AAC in a comparable subject with a tumor dosed with an equivalent molar concentration. In the foregoing embodiment, the cytokines can be assessed from a blood, fluid, or tissue sample removed from the subject. In the foregoing embodiment, the subject can be mouse, rat, monkey, and human. In an advantage of the subject AACs, however, it has been discovered that the cytolytic properties of the compositions do not require prestimulation by cytokines; that formation of the immunological synapse of the effector cell bound to the target cell by the binding moieties is sufficient to effect cytolysis or apoptosis in the target cell. Nevertheless, the production of proinflammatory cytokines are useful markers to assess the potency or the effects of the subject AACs; whether by in vitro assay or in the monitoring of treatment of a subject with a tumor.

In accordance with the binding moiety embodiments referred to above, it is advantageous if the binding site recognizing the target cell marker antigen has a high binding affinity in order to capture the target cells to be destroyed with high efficiency. The AACs of the disclosure have the advantage that they may be used a number of times for killing tumour cells since, in preferred embodiments, the target cell binding moiety of the released target cell binding moiety has an affinity with a $K_d$ value in the range of $10^{-7}$ to $10^{-10}$ M, as determined in an in vitro binding assay. If the affinity of a bispecific binding moiety for binding a target cell marker is too high, the composition binds the expressing target cell and remains on its surface, making it unable to release and bind to another cell. In one embodiment, the released effector cell binding moiety of a subject AAC has a binding constant of between $10^{-5}$ and $10^{-8}$M, as determined in an in vitro binding assay, detailed examples of which are described in the Examples, below. In another embodiment, the released effector cell binding moiety (FBM) of a subject AAC has a lower binding affinity to the effector cell ligand of at least one order of magnitude lower compared to the greater binding affinity of the SBM to the target cell marker, as determined as a $K_d$ constant in an in vitro assay.

In another aspect, it is a feature of the designed compositions that when the RS of the AAC is cleaved by a mammalian protease in the environment of the target cell and is converted from the prodrug form to the activated or apoprotein form, upon cleavage and release of the bispecific binding moieties and the XTEN from the composition, the fused FBM and SBM bind to and link together an effector cell (e.g., a T cell bearing CD3) and a tumor or cancer cell bearing the target cell marker of a target cell targeted by the SBM, whereupon the effector cell is activated. In one embodiment, wherein RS of the AAC is cleaved and the binding moieties are released, the subsequent concurrent binding of the effector cell and the target cell results in at least a 3-fold, or a 10-fold, or a 30-fold, or a 100-fold, or a 300-fold, or a 1000-fold activation of the effector cell, wherein the activation is assessed by the production of cytokines, cytolytic proteins, or lysis of the target cell, assessed in an in vitro cell-based assay. In another embodiment, the concurrent binding of a T cell bearing the CD3 antigen and a tumor cell bearing the target cell marker of a target cell by the released binding moieties forms an immunologic synapse, wherein the binding results in the release of T cell-derived effector molecules capable of lysing the tumor cell. Non-limiting examples of the in vitro assay for measuring effector cell activation and/or cytolysis include cell membrane integrity assay, mixed cell culture assay, FACS based propidium Iodide assay, trypan Blue influx assay, photometric enzyme release assay, ELISA, radiometric 51Cr release assay, fluorometric Europium release assay, CalceinAM release assay, photometric MTT assay, XTT assay, WST-1 assay, alamarBlue assay, radiometric 3H-Thd incorporation assay, clonogenic assay measuring cell division activity, fluorometric Rhodamine123 assay measuring mitochondrial transmembrane gradient, apoptosis assay monitored by FACS-based phosphatidylserine exposure, ELISA-based TUNEL test assay, caspase activity assay, and cell morphology assay, or other assays known in the art for the assay of cytokines, cytolytic proteins, or lysis of cells, or the methods of the Examples, below.

It will be appreciated by one of skill in the art that in the context of treatment of a subject using the subject compositions, the AAC are present in a prodrug form and are converted to a more active form when entering a certain cellular environment by the action of proteases co-localized with the disease tissue or cell. Upon release from the composition by the action of the protease(s) in the target tissue, the first binding moiety with binding specificity to an effector cell antigen and the linked second binding moiety with binding specificity to a tumor-specific marker or an antigen of a target cell regain their full capability to bind to and link together the effector cell to the target cell, forming an immunological synapse. The formation of the immuological synapse causes the effector cell to become activated, with various signal pathways turning on new gene transcription and the release, by exocytosis, the effector molecule contents of its vesicles. Depending on the type of effector cell, different cytokines and lymphokines are released; e.g., Type 1 helper T cells (Th1) release cytokines like IFN-gamma, IL-2 and TNF-alpha while Type 2 helper T cells (Th2) release cytokines like IL-4, IL-5, IL-10, and IL-13 that stimulate B cells, and cytotoxic T Lymphocytes (CTLs) release cytotoxic molecules like perform and granzymes that kill the target (collectively, "effector molecules"). It is specifically contemplated that upon the concurrent binding to and linking together the effector cell to the target tumor cell by the released bispecific binding moieties of the AAC, at very low effector to target (E:T) ratios the tumor cell is acted upon by the effector molecules released by the effector cell into the immunological synapse between the cells, resulting in damage, perform-mediated lysis, granzyme B-induced cell death and/or apoptosis of the tumor cell. Thus, in another aspect, it is a feature of the designed composition that when the activatable recombinant polypeptide composition is administered to a subject with a tumor, the prodrug form remains in the circulatory system in normal tissue but is able to extravasate in the more permeable vasculature of the tumor such that the prodrug form of the assembly is activated by the proteases co-localized with the tumor and that the released binding moieties bind together and link an effector cell (e.g., a T cell) and a tumor cell expressing the target cell marker targeted by the SBM of the composition, whereupon the effector cell is activated and lysis of the tumor cell is effected. In one embodiment of the foregoing, the released binding moiety in the tumor of the subject bound to both a tumor cell and an effector cell exhibits an increased ability to activate effector cells of at least 10-fold, or at least 30-fold, or at least 100-fold, or at least 200-fold, or at least 300-fold, or at least 400-fold, or at least 500-fold, or at least 1000-fold compared to the corresponding intact, uncleaved AAC. In another embodiment of the foregoing, the released binding moieties in the tumor of the subject bound to both a tumor cell and an effector cell exhibits an increased ability to lyse the tumor cell of at least 10-fold, or at least 30-fold, or at least 100-fold, or at least 200-fold, or at least 300-fold, or at least 400-fold, or at least 500-fold, or at least 1000-fold compared to the corresponding intact AAC that has not been cleaved. In the foregoing embodiments, the effector cell activation and/or the cytotoxicity can be assayed by conventional methods known in the art, such as cytometric measurement of activated effector cells, assay of cytokines, measurement of tumor size, or by histopathology. In the foregoing embodiments, the subject can be mouse, rat, dog, monkey, and human. In particular, it is specifically contemplated that the subject compositions are designed such that they have an enhanced therapeutic index and reduced toxicity or side effects, achieved by a combination of the shielding effect and steric hindrance of XTEN on binding affinity over the binding moieties in the prodrug form, yet are able to release the bispecific binding moieties (achieved by inclusion of the cleavage sequences in the RS) in proximity to or within a target tissue (e.g., a tumor) that produces a protease for which the RS is a substrate.

In general, XTEN with cumulative lengths longer that about 400 residues incorporated into the compositions result in increased hydrodynamic radii, increased apparent molecular weight, and increased apparent molecular weight factor of a recombinant protein compared to a protein not linked to an XTEN. For example, incorporation of the XTEN can effectively enlarge the hydrodynamic radius of the subject compositions beyond the glomerular pore size of approximately 3-5 nm (corresponding to an apparent molecular weight of about 70 kDa) (Caliceti. 2003. Pharmacokinetic and biodistribution properties of poly(ethylene glycol)-protein conjugates. Adv Drug Deliv Rev 55:1261-1277), resulting in reduced renal clearance of circulating proteins with a corresponding increase in terminal half-life. The increased hydrodynamic radius imparted by XTEN also reduces the extravasation of intact prodrug form of the AAC from the circulatory system in areas of normal, healthy tissue with average pore sizes of 5-12 nm, but permits the exit of the intact composition molecules in blood vessels that permeate tumors, where the epithelial cell junctions are more porous. It has long been known that various functions of tumor vasculature are impaired, such as a higher vascular permeability than normal vessels (Duran-Reynals, F. Studies on the localization of dyes and foreign proteins in normal and malignant tissue. Am J Cancer 35:98-107 (1939); Babson A L, Winnick T. Protein transfer in tumor-bearing rats. Cancer Res 14:606-611 (1954)). These impaired functions contribute to the higher concentration of plasma proteins detected in tumor tissues than in normal tissues; a phenomenon was elucidated by Maeda and colleagues (Matsumura Y, Maeda H. Cancer Res 46:6387-6392 (1986); Maeda H, Matsumura Y. Tumoritropic and lymphotropic principles of macromolecular drugs. Crit Rev Ther Drug Carrier Syst 6:193-210 (1989), who described it as the enhanced permeability and retention effect, resultings from a combination of the increased permeability of tumor blood vessels and the decreased rate of clearance of functional lymphatic vessels in the tumor, with the net result that macromolecules accumulate in tumors. It is generally known that the physiologic upper limit of pore size in the capillary walls of most non-sinusoidal blood capillaries to the passage of non-endogenous macromolecules ranges between 5 and 12 nm (Hemant Sarin. J Angiogenes Res. 2010; 2:14), while inter-endothelial cell gaps in the blood-tumor barrier of both brain tumors and peripheral tumors have been reported to range between 40 nm and 200 nm or greater in diameter (Sarin, H. et al. J. Translational Medicine 2009 7:51). In an object of the disclosure, the subject AAC were designed to take advantage of this differential in pore size by the addition of the XTEN, such that extravasation of the intact AAC in normal tissue is reduced, but in the leaky environment of the tumor vasculature or other areas of inflammation, the intact assembly can extravasate and be activated by the proteases in the tumor environment, releasing the binding moieties to the effector and target cells. In the case of the RS of the AAC, the design takes advantage of the circumstance that when an AAC is in proximity to diseased tissues; e.g., a tumor, that elaborates one or more proteases, the RS sequences that are susceptible to the one or more proteases expressed by the tumor are capable of being cleaved by the proteases (described more fully, above). The action of the protease cleaves the release segment (RS) of the composition, separating the binding moieties from the XTEN, resulting in components with reduced molecular weight and hydrodynamic radii, particularly for the released binding moieties. As will be appreciated, the decrease in molecular weight and hydrodynamic radius of the composition also confers the property that the released binding moieties are able to more freely move in solution, move through smaller pore spaces in tissue and tumors, and extravsate more readily from the larger pores of the tumor vasculature and more readily penetrate into the tumor, resulting in an increased ability to attach and link together the effector cell and the tumor cell. Such property can be measured by different assays.

In one embodiment, wherein the RS of the AAC is cleaved by a mammalian protease, upon cleavage and release of the bispecific binding moieties and the XTEN from the AAC, the binding moieties have a diffusion coefficient in phosphate buffered saline that is at least 2-fold, 3-fold, 4-fold, 5-fold, 6-fold, 7-fold, 8-fold, 9-fold, 10-fold, 20-fold, 50-fold, or 100-fold greater compared to the intact AAC composition. In another embodiment, the apparent molecular weight of the intact AAC composition is at least 2-fold, at least 3-fold, at least 4-fold, or at least 5-fold, or at least 10-fold greater than the binding moieties released by cleavage of the RS by a mammalian protease, when the apparent molecular weight is determined by size exclusion chromatography (SEC). In another embodiment, the hydrodynamic radius of the intact AAC composition is at least 2-fold, or at least 3-fold, or at least 4-fold, or at least 5-fold, or at least 10-fold greater than the binding moieties released by cleavage of the RS by a mammalian protease, when the hydrodynamic radius is determined by size exclusion chromatography (SEC). In another embodiment, the disclosure provides an AAC, wherein upon cleavage of the RS to release the binding moieties and the XTEN from the AAC, the hydrodynamic radius of the released binding moieties is less than about 30%, or less than about 40%, or less than about 50% of the hydrodynamic radius of the intact AAC, when hydrodynamic radius is assessed by size exclusion chromatography. In another embodiment, the disclosure provides an AAC, wherein upon cleavage of the RS to release the binding moieties and the XTEN from the AAC, the hydrodynamic radius of the released binding moieties is less than about 5 nm, or less than about 4 nm, or less than about 3 nm when hydrodynamic radius is determined by size exclusion chromatography. In another embodiment, the disclosure provides an AAC, wherein upon cleavage of the RS to release the binding moieties and the XTEN from the AAC, the released binding moieties having a hydrodynamic radius of less than about 5 nm, or less than about 4 nm, or less than about 3 nm, when hydrodynamic radius is determined by size exclusion chromatography, has greater ability to penetrate a tumor tissue compared to an intact AAC. In another embodiment, the disclosure provides an AAC, wherein the hydrodynamic radius of the intact, uncleaved AAC is greater than about 8 nm, or greater than about 9 nm, or greater than about 10 nm, or greater than about 12 mm when hydrodynamic radius is determined by size exclusion chromatography.

It is contemplated that the subject compositions will, by their design and linkage to XTEN, have enhanced pharmacokinetic properties when administered to a subject compared to the corresponding binding moieties not linked to XTEN. In one embodiment, an AAC composition administered to a subject using a therapeutically-effective dose exhibits a terminal half-life in a subject that is increased, upon or following administration to a subject, in comparison to the corresponding binding moieties not linked to the composition, by at least about 2-fold, 3-fold, 4-fold, 5-fold, 6-fold, 7-fold, 8-fold, 9-fold, 10-fold, 20-fold, 30-fold, 40-fold, or 100-fold greater. In another embodiment, an AAC composition administered to a subject using a therapeutically-effective dose exhibits increased area under the curve (AUC), upon or following administration to a subject, in comparison to the corresponding binding moieties not linked to the composition, of at least 25%, 50%, 100%, 200%, or at least 300% or more. In another embodiment, an AAC composition administered to a subject using a therapeutically-effective dose exhibits a lower volume of distribution, upon or following administration to a subject, in comparison to the corresponding binding moieties not linked to the composition, of at least 25% lower, or 50%, or 100%, or 200%, or at least 300% lower. In one embodiment, an AAC composition administered to a subject using a therapeutically-effective dose exhibits a terminal half-life of at least about 20 h, or at least about 30 h, or at least about 32 h, or at least about 48 h, or at least about 72 h, or at least about 96 h, or at least about 120 h, or at least about 144 h, or at least about 7 days, or at least about 10 days, or at least about 14 days following administration to a subject. In another aspect, it is specifically contemplated that because of the design of the subject AAC that are preferentially activated by protease(s) in association with a diseased tissue such as, but not limited to, a tumor, the concentration of the released binding moieties in the circulation of a subject will be low, thereby contributing to the improved safety profile and lower incidence of side effects compared to bispecific compositions not having the protective XTEN and release segment. In one embodiment, the disclosure provides an AAC, wherein the plasma Cmax concentration of the binding moieties released from the AAC by cleavage of the RS by a protease capable of cleaving the RS of the composition upon or following a single administration of the chimeric polypeptide composition to a subject does not exceed about 0.01 ng/ml, or about 0.03 ng/ml, or about 0.1 ng/ml, or about 0.3 ng/ml, or about 1 ng/ml, or about 10 ng/ml, or about 100 ng/ml. In another embodiment, the disclosure provides an AAC, wherein the plasma Cmax concentration of the binding moieties released from the AAC following a single administration of the chimeric polypeptide composition to a subject in which the RS has been cleaved by a protease capable of cleaving the RS of the composition is a least 10-fold lower, or at least 30-fold lower, or at least 100-fold, or at least 1000-fold lower than the plasma levels of the intact AAC in the same subject. In the foregoing embodiments of the paragraph, the subject is a mouse, or a rat, or a dog, or a monkey, or a human.

The AAC constructs described herein confer multiple therapeutic advantages over traditional monoclonal antibodies and other smaller bispecific molecules. Of particular note is the conditional activation of the AAC of the present disclosure. The constructs have a reduced ability to bind their intended target cell markers due to the shielding effect of the bulky, unstructured XTEN tethered to the AAC by the release segment. Thus, the specific activity to non-diseased, normal tissue of the exemplary compositions of the disclosure is significantly reduced when compared to that of analogous antibodies and antibody fragments. The ability of the polypeptides to activate at their desired site of action (e.g., the proximity of a diseased tissue such as a tumor or cancer cell) while remaining inactive during their progress to this site is an advance in the field of immune-oncologic therapeutics, offering the promise of potent and specific therapeutics with improved therapeutic index, as well as a readily designable and manufacturable format.

VII. Methods and Uses of Recombinant Polypeptide Compositions

In another aspect, the present disclosure provides cleavable recombinant polypeptide compositions and activatable antibody compositions and pharmaceutical compositions comprising a recombinant polypeptide or an activatable antibody that are particularly useful in medical settings; for example in the prevention, treatment and/or the amelioration of certain cancers, tumors or inflammatory diseases.

A number of therapeutic strategies have been used to design the recombinant polypeptide compositions for use in methods of treatment of a subject with a cancerous disease, including the modulation of T cell responses by targeting TcR signaling, particularly using VL and VH portions of anti-human CD3 monoclonal antibodies that are widely used clinically in immunosuppressive regimes. The CD3-specific monoclonal OKT3 was the first such monoclonal approved for use in humans (Sgro, Toxicology 105 (1995), 23-29) and is widely used clinically as an immunosuppressive agent in transplantation (Chatenoud L: Immunologic monitoring during OKT3 therapy. Clin Transplant 7:422-430, 1993). Moreover, anti-CD3 monoclonals can induce partial T cell signaling and clonal anergy (Smith, J. Exp. Med. 185 (1997), 1413-1422). The OKT3 reacts with and blocks the function of the CD3 complex in the membrane of T cells; the CD3 complex being associated with the antigen recognition structure of T cells (TCR), which is essential for signal transduction. These and other such CD3 specific antibodies are able to induce various T cell responses, including cytokine production (Von Wussow, Human gamma interferon production by leukocytes induced with monoclonal antibodies recognizing T cells. J. Immunol. 127:1197-1200 (1981)), proliferation and suppressor T-cell induction. In cancer, attempts have been made to utilize cytotoxic T cells to lyse cancer cells. Without being bound by theory, to effect target cell lysis, cytotoxic T cells are believed to require direct cell-to-cell contact; the TCR on the cytotoxic T cell must recognize and engage the appropriate antigen on the target cell. This creates the immunologic synapse that, in turn initiates a signaling cascade within the cytotoxic T cell, causing T-cell activation and the production of a variety of cytotoxic cytokines and effector molecules. Perform and granzymes are highly toxic molecules that are stored in preformed granules that reside in activated cytotoxic T cells. After recognition of the target cell, the cytoplasmic granules of the engaged cytotoxic T cells migrate toward the cytotoxic T-cell membrane, ultimately fusing with it and releasing their contents in directed fashion into the immunological synapse to form a pore within the membrane of the target cell, disrupting the tumor cell plasma membrane. The created pore acts as a point of entry for granzymes; a family of serine proteases that that induce apoptosis of the tumor cells. The disclosure contemplates methods of use of AAC that are engineered to target a range of malignant cells, such as tumors, in addition to the effector cells, in order to initiate target cell lysis and to effect a beneficial therapeutic outcome in that the AAC are designed such that one binding moiety binds and engages CD3 to activate the cytotoxic T cell while the second binding moiety can be designed to target a variety of different target cell markers that are characteristic of specific malignancies; bridging them together for the creation of the immunological synapse. In a particular advantage of the design, the physical binding of the cytotoxic effector cell and the cancer cell eliminates the need for antigen processing, MHCI/β2-microglobulin, as well as co-stimulatory molecules. Examples of important tumor cell markers include, but are not limited to the markers of Table 5. Because of the range of tumor-specific markers (more extensively described, above) that can be engineered into the various embodiments of the subject compositions AAC, it will be appreciated that the resulting compositions will have utility against a variety of cancers, including solid and hematological tumors. In one embodiment, the disclosure provides a method of treatment of a subject with a tumor.

The tumor being treated can comprise tumor cells arising from a cell selected from the group consisting of stromal cell, fibroblasts, myofibroblasts, glial cells, epithelial cells, fat cells, lymphocytic cells, vascular cells, smooth muscle cells, mesenchymal cells, breast tissue cells, prostate cells, kidney cells, brain cells, colon cells, ovarian cells, uterine cells, bladder cells, skin cells, stomach cells, genito-urinary tract cells, cervix cells, uterine cells, small intestine cells, liver cells, pancreatic cells, gall bladder cells, bile duct cells, esophageal cells, salivary gland cells, lung cells, and thyroid cells. In a further advantage of the compositions, as the cytotoxic effector cells are not consumed during the damage/destruction of the bridged target cancer cell, after causing lysis of one target cell, an activated effector cell can release and move on through the local tissue towards other target cancer cells, bind the target antigen, and initiate additional cell lysis. In addition, it is contemplated that in a localized environment like a solid tumor, the release of effector cell molecules such as perform and granzymes will result in damage to tumor cells that are adjacent but not bound by a given molecule of the bispecific binding domains, resulting in stasis of growth or regression of the tumor.

Accordingly, a utility of the disclosure will be understood; that after administration of a therapeutically effective dose of pharmaceutical composition comprising an AAC described herein to a subject with a cancer or tumor having the target cell marker, the composition can be acted upon by proteases in association with or co-localized with the cancer or tumor cells, releasing the fused FBM and SBM such that an immunological synapse can be created by the linking of the target cell and a effector cell, with the result that effector cell-derived effector molecules capable of lysing the target cell are released into the synapse, leading to apoptosis, cytolysis, or death of the target cancer or tumor cell. Furthermore, it will be appreciated by one of skill in the art that use of the AAC can result in a sustained and more generalized beneficial therapeutic effect than a "single kill" once the immunological synapse is formed by the binding of the released binding domains to the effector cell and target cancer cell.

In one aspect, the disclosure relates to methods of treating a disease in a subject, such as a cancer or an inflammatory disorder. In some embodiments, the disclosure provides a method of treating a disease in a subject, comprising administering to the subject in need thereof a therapeutically effective amount of a pharmaceutical composition comprising a recombinant polypeptide or AAC described herein. A therapeutically effective amount of the pharmaceutical composition may vary according to factors such as the disease state, age, sex, and weight of the individual, and the ability of the antibody or antibody portion to elicit a desired response in the individual. A therapeutically effective amount is also one in which any toxic or detrimental effects of the subject compositions are outweighed by the therapeutically beneficial effects. A prophylactically effective amount refers to an amount of pharmaceutical composition required for the period of time necessary to achieve the desired prophylactic result.

In one embodiment of the method of treating a disease in a subject, the disease for treatment can be carcinomas, Hodgkin's lymphoma, non-Hodgkin's lymphoma, B cell lymphoma, T-cell lymphoma, follicular lymphoma, mantle cell lymphoma, blastoma, breast cancer, colon cancer, prostate cancer, head and neck cancer, any form of skin cancer, melanoma, genito-urinary tract cancer, ovarian cancer, ovarian cancer with malignant ascites, peritoneal carcinomatosis, uterine serous carcinoma, endometrial cancer, cervical cancer, colorectal cancer, an epithelia intraperitoneal malignancy with malignant ascites, uterine cancer, mesothelioma in the peritoneum kidney cancers, lung cancer, small-cell lung cancer, non-small cell lung cancer, gastric cancer, esophageal cancer, stomach cancer, small intestine cancer, liver cancer, hepatocarcinoma, hepatoblastoma, liposarcoma, pancreatic cancer, gall bladder cancer, cancers of the bile duct, salivary gland carcinoma, thyroid cancer, epithelial cancer, adenocarcinoma, sarcomas of any origin, primary hematologic malignancies including acute or chronic lymphocytic leukemias, acute or chronic myelogenous leukemias, myeloproliferative neoplastic disorders, or myelodysplastic disorders, myasthenia gravis, Morbus Basedow, Hashimoto thyroiditis, or Goodpasture syndrome. The therapeutically effective amount can produce a beneficial effect in helping to treat (e.g., cure or reduce the severity) or prevent (e.g., reduce the likelihood of recurrence) of a cancer or a tumor. In another embodiment of the method of treating the disease in a subject, the pharmaceutical composition is administered to the subject as two or more therapeutically effective doses administered twice weekly, once a week, every two weeks, every three weeks, or monthly. In another embodiment of the method, the pharmaceutical composition is administered to the subject as two or more therapeutically effective doses over a period of at least two weeks, or at least one month, or at least two months, or at least three months, or at least four months, or at least five months, or at least six months. In another embodiment of the method, a first low priming dose is administered to the subject, followed by one or more higher maintenance doses over the dosing schedule of at least two weeks, or at least one month, or at least two months, or at least three months, or at least four months, or at least five months, or at least six months. The initial priming dose administered is selected from the group consisting of at least about 0.005 mg/kg, at least about 0.01 mg/kg, at least about 0.02 mg/kg, at least about 0.04 mg/kg, at least about 0.08 mg/kg, at least about 0.1 mg/kg, and one or more subsequent maintenance dose(s) administered is selected from the group consisting of at least about 0.02 mg/kg, at least about 0.05 mg/kg, at least about 0.1 mg/kg, at least about 0.16 mg/kg, at least about 0.18 mg/kg, at least about 0.20 mg/kg, at least about 0.22 mg/kg, at least about 0.24 mg/kg, at least about 0.26 mg/kg, at least about 0.27 mg/kg, at least about 0.28 mg/kg, at least about 0.3 mg/kg, at least 0.4. mg/kg, at least about 0.5 mg/kg, at least about 0.6 mg/kg, at least about 0.7 mg/kg, at least about 0.8 mg/kg, at least about 0.9 mg/kg, at least about 1.0 mg/kg, at least about 1.5 mg/kg, or at least about 2.0 mg/kg. In another embodiment of the method, the pharmaceutical composition is administered to the subject intradermally, subcutaneously, intravenously, intra-arterially, intra-abdominally, intraperitoneally, intrathecally, or intramuscularly. In another embodiment of the method, the pharmaceutical composition is administered to the subject as one or more therapeutically effective bolus doses or by infusion of 5 minutes to 96 hours as tolerated for maximal safety and efficacy. In another embodiment of the method, the pharmaceutical composition is administered to the subject as one or more therapeutically effective bolus doses or by infusion of 5 minutes to 96 hours, wherein the dose is selected from the group consisting of at least about 0.005 mg/kg, at least about 0.01 mg/kg, at least about 0.02 mg/kg, at least about 0.04 mg/kg, at least about 0.08 mg/kg, at least about 0.1 mg/kg, at least about 0.12 mg/kg, at least about 0.14 mg/kg, at least about 0.16 mg/kg, at least about 0.18 mg/kg, at least about 0.20 mg/kg, at least about 0.22 mg/kg, at least about 0.24 mg/kg, at least about 0.26 mg/kg, at least about 0.27 mg/kg, at least about 0.28 mg/kg, at least 0.3 mg/kg, at least 0.4. mg/kg, at least about 0.5 mg/kg, at least about 0.6 mg/kg, at least about 0.7 mg/kg, at least about 0.8 mg/kg, at least about 0.9 mg/kg, at least about 1.0 mg/kg, at least about 1.5 mg/kg, or at least about 2.0 mg/kg. In another embodiment of the method, the pharmaceutical composition is administered to the subject as one or more therapeutically effective bolus doses or by infusion over a period of 5 minutes to 96 hours, wherein the administration to the subject results in a Cmax plasma concentration of the intact, uncleaved AAC of at least about 0.1 ng/mL to at least about 2 µg/mL or more in the subject that is maintained for at least about 3 days, at least about 7 days, at least about 10 days, at least about 14 days, or at least about 21 days. The therapeutically effective dose is at least about 0.005 mg/kg, at least about 0.01 mg/kg, at least about 0.02 mg/kg, at least about 0.04 mg/kg, at least about 0.08 mg/kg, at least about 0.1 mg/kg, at least about 0.12 mg/kg, at least about 0.14 mg/kg, at least about 0.16 mg/kg, at least about 0.18 mg/kg, at least about 0.20 mg/kg, at least about 0.22 mg/kg, at least about 0.24 mg/kg, at least about 0.26 mg/kg, at least about 0.27 mg/kg, at least about 0.28 mg/kg, at least 0.3 mg/kg, at least 0.4 mg/kg, at least about 0.5 mg/kg, at least about 0.6 mg/kg, at least about 0.7 mg/kg, at least about 0.8 mg/kg, at least about 0.9 mg/kg, at least about 1.0 mg/kg, at least about 1.5 mg/kg, or at least about 2.0 mg/kg. In one embodiment, an initial dose is selected from the group consisting of at least about 0.005 mg/kg, at least about 0.01 mg/kg, at least about 0.02 mg/kg, at least about 0.04 mg/kg, at least about 0.08 mg/kg, at least about 0.1 mg/kg, and a subsequent dose is selected from the group consisting of at least about 0.1 mg/kg, at least about 0.12 mg/kg, at least about 0.14 mg/kg, at least about 0.16 mg/kg, at least about 0.18 mg/kg, at least about 0.20 mg/kg, at least about 0.22 mg/kg, at least about 0.24 mg/kg, at least about 0.26 mg/kg, at least about 0.27 mg/kg, at least about 0.28 mg/kg, at least 0.3 mg/kg, at least 0.4. mg/kg, at least about 0.5 mg/kg, at least about 0.6 mg/kg, at least about 0.7 mg/kg, at least about 0.8 mg/kg, at least about 0.9 mg/kg, at least about 1.0 mg/kg, at least about 1.5 mg/kg, or at least about 2.0 mg/kg. In the foregoing embodiments, the administration to the subject results in a plasma concentration of the recombinant polypeptide of at least about 0.1 ng/mL to at least about 2 ng/mL or more in the subject for at least about 3 days, at least about 7 days, at least about 10 days, at least about 14 days, or at least about 21 days. In the foregoing embodiments of the method, the subject can be mouse, rat, monkey, and human.

In particular, the pharmaceutical compositions can be used for the treatment of epithelial cancer, preferably adenocarcinomas, or minimal residual disease, more preferably early solid tumor, advanced solid tumor or metastatic solid tumor. In addition, the pharmaceutical compositions provided in this disclosure are useful in the treatment of sarcomas. In addition, the pharmaceutical compositions comprising a recombinant polypeptide provided in this disclosure are useful in the treatment of lymphomas and leukemias, including primary hematologic malignancies including acute or chronic lymphocytic leukemias, acute or chronic myelogenous leukemias, myeloproliferative neoplastic disorders, or myelodysplastic disorders, B-cell disorders such as B-cell lymphoma, Hodgkin's lymphoma, and non-Hodgkin's lymphoma, diffuse large B cell lymphoma, follicular lymphoma, mantle cell lymphoma, blastoma, B-cell derived chronic lymphatic leukemia (B-CLL) and/or having a B-cell related autoimmune disease such as myasthenia gravis, Morbus Basedow, Hashimoto thyroiditis, or Goodpasture syndrome. In addition, the pharmaceutical compositions comprising a recombinant polypeptide provided in this disclosure are useful in the treatment of cancers leading to ascites, including genito-urinary tract cancer, ovarian cancer, ovarian cancer with malignant ascites, peritoneal carcinomatosis, uterine serous carcinoma, endometrial cancer, cervix cancer, colorectal, uterine cancer, mesothelioma in the peritoneum, pancreatic cancer, colon cancer, colon cancer with malignant ascites, and gastric cancer.

In one aspect, the disclosure provides a method of for achieving a beneficial effect in a cancer or tumor mediated by administration of pharmaceutical compositions comprising recombinant polypeptide or AAC compositions. In one embodiment of the method, the disclosure provides the use of a pharmaceutical composition in a method of treatment of a cancer or tumor in a subject in need thereof by administration of a therapeutically effective amount of the pharmaceutical composition in which one binding moiety of the composition is derived from a parental antibody that binds to an effector cell CD3 antigen and a second binding domain is derived from a parental antibody that binds to a target cell marker antigen selected from the group consisting of A33 antigen, alpha-fetoprotein (AFP), alpha 4 integrin, Ang2, B7-H3, B7-H6, B-cell maturation antigen (BCMA), cancer antigen 19-9 (CA19-9), cancer antigen 125 (CA-125), Carbonic Anhydrase 6 (CA6), carbonic anhydrase IX (CAIX), CEACAM5, cMET, CTLA4, C-C Motif Chemokine Receptor 1 (CCR1), C-C Motif Chemokine Receptor 2 (CCR2), C-C Motif Chemokine Receptor 3 (CCR3), C-C Motif Chemokine Receptor 4 (CCR4), C-C Motif Chemokine Receptor 5 (CCR5), C-C Motif Chemokine Receptor 6 (CCR6), C-C Motif Chemokine Receptor 7 (CCR7), C-C Motif Chemokine Receptor 8 (CCR8), C-C Motif Chemokine Receptor 9 (CCR9), Cluster of Differentiation 7 (CD7), CD22, CD70, CD79a, CD79b, CD19, CCR8, CEA, βhCG, Lewis-Y, CA19-9, CA-125, CD20, CD22, CD25, CD33, CD38, CD30, CD44v6, CD47, CD56 (NCAM), CD63, CD79b, CD123, CD133, CD138, CD166, claudin-1, claudin 18.2, C-type lectin-like molecule-1 (CLL-1), C-type lectin domain family 12 (CLEC12), Cora antigen, delta like canonical notch ligand 3 (DDL3), desmoglein 4, delta like non-xanonical notch ligand 1 (DLK1), Ectonucleotide Pyrophosphatase/Phosphodiesterase 3 (ENPP3), EGFR, EGFRvIII, EpCAM, endosialin (CD248), epidermal growth factor receptor variant III (EGFRvIII), EphA2, F19 antigen, fetal acetylcholine receptor (fnAChR), fibroblast activation antigen (FAP), Fos-related antigen 1 (FRA1), Folate Receptor 1 (FOLR1), fucosyl GM1, G250, ganglioside GD3, glypican-3 (GPC3), 9-O-Acetyl-GD3, GM2, Glucocorticoid induced TNF receptor (GITR), globohexaosylceramide (globo-H), GD2, Glypican 3 (GPC3), guanylyl cyclase C (GCC), HER2, HER2 neu, HER3, HER4, HER1, IL13Rα2, insulin-like growth factor I receptor (IGF-IR), Lysosomal Associated Membrane Protein 1 (LAMP1), L1 Cell Adhesion Molecule (LICAM), lymphocyte antigen 6 (Ly-6), melanoma chondroitin sulfate proteoglycan (MCSP), Membrane-type metalloproteinase (MT-MMP), mesothelin, mucin 1 (MUC1), MUC2, MUC3, MUC4, MUC5AC, MUC5B, MUC7, MUC16, Muellerian inhibitory substance receptor type II (MISIIR), nectin cell adhesion molecule 4 (Nectin-4), 6-transmembrane epithelial antigen of prostate (STEAP), plasma cell antigen 1, prostate stem cell antigen (PSCA), Programmed Cell Death 1 (PD1), Programmed death-ligand 1 (PD-L1), PSMA, Receptor Tyrosine Kinase Like Orphan Receptor 1 (ROR1), sialylated Tn antigen (s TN), sodium-dependent phosphate transport protein 2b (NaPi2b), Sonic Hedgehog (Shh), SAS, SLAM Family Member 7 (SLAM7), Somatostatin Receptor 2 (SSTR2), Sperm Autoantigenic Protein 17 (SP17), TAG72, Thomsen-Friedenreich antigen (TF-antigen), tumor-associated antigen L6 (TAL6), trophoblast glycoprotein (5T4), Trop-2, Wue-1, VEGFR1, VEGFR2, and Wilms tumor protein (WT1). In one embodiment of the method, the administration of the therapeutically effective amount of the pharmaceutical composition leads to the eradication or amelioration of the underlying cancer or tumor disorder such that an improvement is observed in the subject, notwithstanding that the subject may still be afflicted with the underlying disorder.

In another embodiment, the disclosure provides use of a pharmaceutical composition comprising an AAC in a method of treatment of a cancer or tumor in a subject by administration of a therapeutically effective amount of the pharmaceutical composition in which one binding moiety of the composition is derived from a parental antibody directed to an effector cell selected from the group consisting of the antibodies of Table 4 and a second binding moiety is derived from a parental antibody that binds to an target cell target antigen selected from the group consisting of the antibodies of Table 5 and further comprising one or more RS of Table 1 or Table 2 and one or more XTEN of Table 8 or Table 10, the AAC having a configuration as described herein. In one embodiment, the pharmaceutical composition doses of the method are administered as a bolus dose. In another embodiment, the pharmaceutical composition doses of the method are each administered by intravenous infusion. In another embodiment, the pharmaceutical composition doses of the method are each administered by intraabdominal infusion. In another embodiment, the pharmaceutical composition doses of the method are each administered by intra-arterial infusion. In another embodiment, the pharmaceutical composition doses of the method are each administered by subcutaneous injection. In another embodiment, the pharmaceutical composition doses of the method are each administered by intramuscular injection. In the foregoing embodiments of this paragraph, the subject is selected from the group consisting of mouse, rat, dog, monkey, and human.

In another aspect, the disclosure relates to a method of treating a cancer or a tumor in a subject according to a treatment regimen. In one embodiment, the disclosure provides a method of treating a cancer or a tumor in a subject comprising administering to the subject with the disease according to a treatment regimen comprising two or more consecutive doses of a therapeutically effective amount of a pharmaceutical composition comprising a recombinant polypeptide or AAC composition disclosed herein. The disclosure provides a method of treating a cancer or a tumor in a subject comprising administering to the subject with the disease according to a treatment regimen comprising two or more consecutive doses of a therapeutically effective amount of the pharmaceutical composition wherein the administration of the therapeutically effective amount of a pharmaceutical composition to the subject achieves a beneficial therapeutic effect including. In another embodiment, the disclosure provides a method of treating a cancer or a tumor in a subject comprising administering to the subject with the disease according to a treatment regimen comprising two or more consecutive doses of a therapeutically effective amount of a pharmaceutical composition disclosed herein wherein the treatment regimen results in the improvement of a clinical parameter or endpoint associated with the disease in the subject. In the foregoing, the clinical parameter or endpoint is selected from one or any combination of the group consisting of tumor shrinkage as a complete, partial or incomplete response; time-to-progression; time to treatment failure; biomarker response; progression-free survival; disease free-survival; time to recurrence; time to metastasis; time of overall survival; improvement of quality of life; and improvement of symptoms.

In another aspect, the disclosure relates to a method of use in which the treatment regimen is part of a specified treatment cycle. In one embodiment of the method, the specified treatment cycle of the treatment regimen comprises administration of a pharmaceutical composition comprising a recombinant polypeptide or AAC disclosed herein twice a week, every week, every 10 days, every two weeks, every three weeks, or every month per each treatment cycle. In another embodiment of the method, the treatment regimen is used in treatment of a disease, wherein the disease is selected from the group consisting of carcinomas, Hodgkin's lymphoma, non-Hodgkin's lymphoma, B cell lymphoma, T-cell lymphoma, follicular lymphoma, mantle cell lymphoma, blastoma, breast cancer, colon cancer, prostate cancer, head and neck cancer, any form of skin cancer, melanoma, genito-urinary tract cancer, ovarian cancer, ovarian cancer with malignant ascites, peritoneal carcinomatosis, uterine serous carcinoma, endometrial cancer, cervical cancer, colorectal cancer, an epithelia intraperitoneal malignancy with malignant ascites, uterine cancer, mesothelioma in the peritoneum kidney cancers, lung cancer, small-cell lung cancer, non-small cell lung cancer, gastric cancer, esophageal cancer, stomach cancer, small intestine cancer, liver cancer, hepatocarcinoma, hepatoblastoma, liposarcoma, pancreatic cancer, gall bladder cancer, cancers of the bile duct, salivary gland carcinoma, thyroid cancer, epithelial cancer, adenocarcinoma, sarcomas of any origin, primary hematologic malignancies including acute or chronic lymphocytic leukemias, acute or chronic myelogenous leukemias, myeloproliferative neoplastic disorders, or myelodysplastic disorders, myasthenia gravis, Morbus Basedow, Hashimoto thyroiditis, or Goodpasture syndrome.

In another aspect, the disclosure relates to improved methods of inducing death of a target cell, such as a cancer cell, utilizing the subject recombinant polypeptide or AAC compositions disclosed herein, wherein the method effects death or induces apoptosis in the target cell or tissue, but with reduced toxicity and side effects. In a particular advantage of the inventive methods, the enhanced properties of the compositions permit lower-dose pharmaceutical formulations or treatment methods using a reduced dosage, reduced dosing frequency and a superior dose regimen, both because of targeted delivery to tissues and cells and because of enhanced pharmacokinetic properties, resulting in a superior therapeutic index; i.e., improved efficacy with reduced toxicity. Consequently, the subject compositions can have superior efficacy and safety compared to the corresponding binding moieties not linked to the recombinant polypeptides or AAC because of the ability of the attached bulking moiety to reduce the non-specific binding to healthy tissues and to prevent extravasation from the circulatory system in healthy tissue, while permitting enhanced penetration and binding into the cancer or tumor tissue upon the cleavage of the RS and release of the binding moieties; thus resulting in a differential compartmentalization of the prodrug form versus the released binding moieties upon cleavage of the composition. In one embodiment, the disclosure provides a method of inducing death of a target cell, the method comprising contacting the target cell and an effector cell with an AAC described herein, wherein the contact results in an effect in the target cell selected from the group consisting of loss of membrane integrity, pyknosis, karyorrhexis, inducement of the intrinsic pathway of apoptosis, inducement of the extrinsic pathway of apoptosis, apoptosis, cell lysis, and cell death. The effect can be determined in an in vitro cell-based assay comprising a mixed population of the target cells and the effector cells, and an effective amount of the recombinant polypeptide having binding affinity for the target cell marker and the effector cell.

In other embodiments, the disclosure provides methods of inducing death of a target cell in a subject having a cancer comprising a population of the target cell. In one embodiment of the method, the method comprises administering a therapeutically effective amount of a pharmaceutical composition comprising the recombinant polypeptide or AAC to the subject. In another embodiment of the method, the method comprises administering the pharmaceutical composition as one or more consecutively administered therapeutically effective doses. In another embodiment of the method, the method comprises determining the amount of a pharmaceutical composition needed to achieve a therapeutic effect in the subject having the cancer and administering the amount as two or more consecutive doses to the subject. In the foregoing methods, the cancer is selected from the group consisting of carcinoma, Hodgkin's lymphoma, and non-Hodgkin's lymphoma, diffuse large B cell lymphoma, follicular lymphoma, mantle cell lymphoma, blastoma, breast cancer, ER/PR+ breast cancer, Her2+ breast cancer, triple-negative breast cancer, colon cancer, colon cancer with malignant ascites, mucinous tumors, prostate cancer, head and neck cancer, skin cancer, melanoma, genito-urinary tract cancer, ovarian cancer, ovarian cancer with malignant ascites, peritoneal carcinomatosis, uterine serous carcinoma, endometrial cancer, cervix cancer, colorectal, uterine cancer, mesothelioma in the peritoneum, kidney cancer, Wilm's tumor, lung cancer, small-cell lung cancer, non-small cell lung cancer, gastric cancer, stomach cancer, small intestine cancer, liver cancer, hepatocarcinoma, hepatoblastoma, liposarcoma, pancreatic cancer, gall bladder cancer, cancers of the bile duct, esophageal cancer, salivary gland carcinoma, thyroid cancer, epithelial cancer, arrhenoblastoma, adenocarcinoma, sarcoma, and B-cell derived chronic lymphatic leukemia. In another embodiment of the method, the method comprises administering a therapeutically effective amount of the pharmaceutical composition to the subject wherein the method results in an improvement of a clinical parameter or endpoint. Exemplary clinical parameters or endpoints can be overall survival, symptom endpoints, disease-free survival, objective response rate, complete response, duration of response, progression-free survival, time to progression, time-to-treatment failure, tumor measurement, tumor size, tumor response rate, time to metastasis, and biomarker concentration. In another embodiment of the method, the method comprises administering a therapeutically effective amount of the pharmaceutical composition to the subject wherein the method results in a reduction in the frequency, duration, or severity in diagnostically associated side effects in the subject compared to administration of a comparable dose, in mmoles/kg, to a comparable subject of a composition comprising the FBM and SBM of the AAC, wherein the side effects are selected from the group consisting of increased plasma levels of IL-2, increased plasma levels of TNF-alpha, increased plasma levels of IFN-gamma, sepsis, febrile neutropenia, neurotoxicity, convulsions, encephalopathy, cytokine release syndrome, speech disturbance, equilibrium disturbance, fever, headache, confusion, hypotension, neutropenia, nausea, impaired consciousness, disorientation, and increased liver enzymes.

The methods of the disclosure may include administration of consecutive doses of a therapeutically effective amount of the pharmaceutical composition for a period of time sufficient to achieve and/or maintain the desired parameter or clinical effect, and such consecutive doses of a therapeutically effective amount establishes the therapeutically effective dose regimen for the pharmaceutical composition; i.e., the schedule for consecutively administered doses, wherein the doses are given in therapeutically effective amounts to result in a sustained beneficial effect on any clinical sign or symptom, aspect, measured parameter or characteristic of a cancer disease state or condition, including, but not limited to, those cancers and tumors described herein.

For the inventive methods, longer acting recombinant polypeptide of AAC compositions are preferred, so as to improve patient convenience, to increase the interval between doses and to reduce the amount of drug required to achieve a sustained effect. In one embodiment, a method of treatment comprises administration of a therapeutically effective dose of a pharmaceutical composition comprising the recombinant polypeptide or AAC to a subject in need thereof that results in a gain in time spent within a therapeutic window established for the binding moiety components of the pharmaceutical composition compared to the corresponding binding moiety components not linked to the fusion protein and administered at a comparable molar dose to a subject. In some cases, the gain in time spent within the therapeutic window is at least about three-fold, or at least about four-fold, or at least about five-fold, or at least about six-fold, or at least about eight-fold, or at least about 10-fold, or at least about 20-fold, or at least about 40-fold, or at least about 50-fold, or at least about 100-fold greater compared to the corresponding binding moiety components not linked to the recombinant protein or AAC and administered at a comparable molar dose to a subject. The methods further provide that administration of multiple consecutive doses of a pharmaceutical composition administered using a therapeutically effective dose regimen to a subject in need thereof can result in a gain in time between consecutive Cmax peaks and/or Cmin troughs for blood levels of the composition compared to the corresponding binding moiety components not linked to the fusion protein. In the foregoing embodiment, the gain in time spent between consecutive Cmax peaks and/or Cmin troughs can be at least about three-fold, or at least about four-fold, or at least about five-fold, or at least about six-fold, or at least about eight-fold, or at least about 10-fold, or at least about 20-fold, or at least about 40-fold, or at least about 50-fold, or at least about 100-fold longer compared to the corresponding binding moiety component(s) not linked to the fusion protein and administered using a comparable molar dose regimen established for the targeting components. In the embodiments hereinabove described in this paragraph the administration of the pharmaceutical composition can result in an improvement in at least one parameter known to be useful for assessing the subject cancer or tumor using a lower unit dose in moles of recombinant polypeptide or AAC compared to the corresponding binding moiety components not linked to the recombinant polypeptide or AAC and administered at a comparable molar dose or dose regimen to a subject.

In another aspect, the disclosure provides methods of manufacturing an AAC. In one embodiment, the method comprises culturing a host cell comprising a nucleic acid construct that encodes an activatable recombinant polypeptide under conditions that lead to expression of the activatable recombinant polypeptide, wherein the activatable recombinant polypeptide comprises an RS1, RS2, FBM, SBM, XTEN1, and XTEN2, wherein: i) the RS1 and RS2, wherein the RS1 and RS2 are each substrates for cleavage by a mammalian protease and each comprise an amino acid sequence having at least 88% or at least 94%, or 100% sequence identity to a sequence selected from the sequences of Table 1; ii) the FBM is an antibody fragment comprising a VL and VH derived from a monoclonal antibody having binding specificity to CD3; iii) the SBM is an antibody fragment comprising a VL and VH derived from a monoclonal antibody having binding affinity to the target cell marker selected from A33 antigen, alpha-fetoprotein (AFP), alpha 4 integrin, Ang2, B7-H3, B7-H6, B-cell maturation antigen (BCMA), cancer antigen 19-9 (CA19-9), cancer antigen 125 (CA-125), Carbonic Anhydrase 6 (CA6), carbonic anhydrase IX (CAIX), CEACAM5, cMET, CTLA4, C-C Motif Chemokine Receptor 1 (CCR1), C-C Motif Chemokine Receptor 2 (CCR2), C-C Motif Chemokine Receptor 3 (CCR3), C-C Motif Chemokine Receptor 4 (CCR4), C-C Motif Chemokine Receptor 5 (CCR5), C-C Motif Chemokine Receptor 6 (CCR6), C-C Motif Chemokine Receptor 7 (CCR7), C-C Motif Chemokine Receptor 8 (CCR8), C-C Motif Chemokine Receptor 9 (CCR9), Cluster of Differentiation 7 (CD7), CD22, CD70, CD79a, CD79b, CD19, CCR8, CEA, βhCG, Lewis-Y, CA19-9, CA-125, CD20, CD22, CD25, CD33, CD38, CD30, CD44v6, CD47, CD56 (NCAM), CD63, CD79b, CD123, CD133, CD138, CD166, claudin-1, claudin 18.2, C-type lectin-like molecule-1 (CLL-1), C-type lectin domain family 12 (CLEC12), Cora antigen, delta like canonical notch ligand 3 (DDL3), desmoglein 4, delta like non-xanonical notch ligand 1 (DLK1), Ectonucleotide Pyrophosphatase/Phosphodiesterase 3 (ENPP3), EGFR, EGFRvIII, EpCAM, endosialin (CD248), epidermal growth factor receptor variant III (EGFRvIII), EphA2, F19 antigen, fetal acetylcholine receptor (fnAChR), fibroblast activation antigen (FAP), Fos-related antigen 1 (FRA1), Folate Receptor 1 (FOLR1), fucosyl GM1, G250, ganglioside GD3, glypican-3 (GPC3), 9-O-Acetyl-GD3, GM2, Glucocorticoid induced TNF receptor (GITR), globohexaosylceramide (globo-H), GD2, Glypican 3 (GPC3), guanylyl cyclase C (GCC), HER2, HER2 neu, HER3, HER4, HER1, IL13Rα2, insulin-like growth factor I receptor (IGF-IR), Lysosomal Associated Membrane Protein 1 (LAMP1), L1 Cell Adhesion Molecule (LiCAM), lymphocyte antigen 6 (Ly-6), melanoma chondroitin sulfate proteoglycan (MCSP), Membrane-type metalloproteinase (MT-MMP), mesothelin, mucin 1 (MUC1), MUC2, MUC3, MUC4, MUC5AC, MUC5B, MUC7, MUC16, Muellerian inhibitory substance receptor type II (MISIIR), nectin cell adhesion molecule 4 (Nectin-4), 6-transmembrane epithelial antigen of prostate (STEAP), plasma cell antigen 1, prostate stem cell antigen (PSCA), Programmed Cell Death 1 (PD1), Programmed death-ligand 1 (PD-L1), PSMA, Receptor Tyrosine Kinase Like Orphan Receptor 1 (ROR1), sialylated Tn antigen (s TN), sodium-dependent phosphate transport protein 2b (NaPi2b), Sonic Hedgehog (Shh), SAS, SLAM Family Member 7 (SLAM7), Somatostatin Receptor 2 (SSTR2), Sperm Autoantigenic Protein 17 (SP17), TAG72, Thomsen-Friedenreich antigen (TF-antigen), tumor-associated antigen L6 (TAL6), trophoblast glycoprotein (5T4), Trop-2, Wue-1, VEGFR1, VEGFR2, and Wilms tumor protein (WT1); iv) the XTEN1 and XTEN2 each comprise an amino acid sequence having at least about 90%, 91%, 92%, 93%, 94%, 95%, 96%, 97%, 98%, 99%, or 100% sequence identity to a sequence selected from the group of sequences set forth in Table 8; v) the recombinant polypeptide has a structural arrangement from N-terminus to C-terminus as follows: XTEN1-RS1-SBM-FBM-RS2-XTEN2, XTEN1-RS1-FBM-SBM-RS2-XTEN2, XTEN2-RS2-SBM-FBM-RS1-XTEN1, XTEN2-RS2-FBM-SBM-RS1-XTEN1, XTEN2-RS2-diabody-RS1-XTEN1, wherein the diabody comprises VL and VH of the FBM and SBM; and recovering the activatable polypeptide composition. In the foregoing method, the activatable recombinant polypeptide is activated by cleavage of the RS1 and RS2 by one or more proteases capable of cleaving the RS1 and RS2, resulting in the release of the FBM and SBM from the composition, wherein the FBM and SBM remain fused and the XTEN1 and XTEN2 of the activatable recombinant polypeptide in an uncleaved state interfere with specific binding of the FBM to the CD3 and the SBM to the target cell marker such that the dissociation constant ($K_d$) of the FBM of the activatable recombinant polypeptide in an uncleaved state towards CD3 or the SBM to the target cell marker is at least 100 times greater compared to the FBM or the SBM released from the activatable recombinant polypeptide by cleavage of the RS1 and RS2, when measured in in vitro assays comprising the target cell marker under comparable conditions, e.g., equivalent molar concentrations.

VIII. Nucleic Acid Sequences

In another aspect, the present disclosure relates to isolated polynucleotide sequences encoding the recombinant polypeptide or AAC compositions and sequences complementary to polynucleotide molecules encoding the recombinant polypeptide or AAC compositions.

In some embodiments, the disclosure provides polynucleotides encoding the recombinant polypeptide or AAC compositions embodiments described herein, or the complement of the polynucleotide sequence. In one embodiment, the disclosure provides an isolated polynucleotide sequence encoding a recombinant polypeptide consisting of an amino acid sequence with at least 90%, 91%, 92%, 93%, 94%, 95%, 96%, 97%, 98%, 99%, or 100% sequence identity to an amino acid sequence set forth in Table 11, Tables 14-16, or Table 18, or the complement of the polynucleotide sequence. In one embodiment, the disclosure provides an isolated polynucleotide sequence encoding an AAC composition wherein the polynucleotide sequence has at least 90%, 91%, 92%, 93%, 94%, 95%, 96%, 97%, 98%, 99%, or 100% sequence identity to a polynucleotide sequence set forth in Table 11, Table 16 or Table 18.

In another aspect, the disclosure relates to methods to produce polynucleotide sequences encoding the recombinant polypeptide composition or AAC embodiments, or sequences complementary to the polynucleotide sequences, including homologous variants thereof, as well as methods to express the proteins expressed by the polynucleotide sequences. In general, the methods include producing a polynucleotide sequence coding for the proteinaceous recombinant polypeptide or AAC composition and incorporating the encoding gene into an expression vector appropriate for a host cell. For production of the encoded recombinant polypeptide or AAC, the method includes transforming an appropriate host cell with the expression vector, and culturing the host cell under conditions causing or permitting the resulting recombinant polypeptide or AAC to be expressed in the transformed host cell, thereby producing the recombinant polypeptide or AAC, which is recovered by methods described herein or by standard protein purification methods known in the art. Standard recombinant techniques in molecular biology are used to make the polynucleotides and expression vectors of the present disclosure.

In accordance with the disclosure, nucleic acid sequences that encode recombinant polypeptide compositions (or its complement) are used to generate recombinant DNA molecules that direct the expression in appropriate host cells. Several cloning strategies are suitable for performing the present disclosure, many of which are used to generate a construct that comprises a gene coding for a composition of the present disclosure, or its complement. In one embodiment, the cloning strategy is used to create a gene that encodes a recombinant polypeptide construct that comprises nucleotides encoding the recombinant polypeptide that is used to transform a host cell for expression of the composition. In the foregoing embodiments hereinabove described in this paragraph, the genes can comprise nucleotides encoding the binding moieties, release segments, and the bulking moieties in the configurations disclosed herein.

In one approach, a construct is first prepared containing the DNA sequence corresponding to recombinant polypeptide construct. Exemplary methods for the preparation of such constructs are described in the Examples. The construct is then used to create an expression vector suitable for transforming a host cell, such as a prokaryotic host cell for the expression and recovery of the recombinant polypeptide construct. Where desired, the host cell is an *E. coli*. Exemplary methods for the creation of expression vectors, the transformation of host cells and the expression and recovery of XTEN are described in the Examples.

The gene encoding for the recombinant polypeptide construct can be made in one or more steps, either fully synthetically or by synthesis combined with enzymatic processes, such as restriction enzyme-mediated cloning, PCR and overlap extension, including methods more fully described in the Examples. The methods disclosed herein can be used, for example, to ligate sequences of polynucleotides encoding the various components (e.g., binding domains, linkers, release segments, and XTEN) genes of a desired length and sequence. Genes encoding recombinant polypeptide compositions are assembled from oligonucleotides using standard techniques of gene synthesis. The gene design can be performed using algorithms that optimize codon usage and amino acid composition appropriate for the *E. coli* host cell utilized in the production of the recombinant polypeptide. In one method of the disclosure, a library of polynucleotides encoding the components of the constructs is created and then assembled, as described above. The resulting genes are then assembled and the resulting genes used to transform a host cell and produce and recover the recombinant polypeptide compositions for evaluation of its properties, as described herein.

The resulting polynucleotides encoding the recombinant polypeptide sequences can then be individually cloned into an expression vector. The nucleic acid sequence is inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques which are known to the skilled artisan. Such techniques are well known in the art and well described in the scientific and patent literature. Various vectors are publicly available. The vector may, for example, be in the form of a plasmid, cosmid, viral particle, or phage that may conveniently be subjected to recombinant DNA procedures, and the choice of vector will often depend on the host cell into which it is to be introduced. Thus, the vector may be an autonomously replicating vector, i.e., a vector, which exists as an extrachromosomal entity, the replication of which is independent of chromosomal replication, e.g., a plasmid. Alternatively, the vector may be one which, when introduced into a host cell, is integrated into the host cell genome and replicated together with the chromosome(s) into which it has been integrated.

The disclosure provides for the use of plasmid expression vectors containing replication and control sequences that are compatible with and recognized by the host cell, and are operably linked to the gene encoding the polypeptide for controlled expression of the polypeptide. The vector ordinarily carries a replication site, as well as sequences that encode proteins that are capable of providing phenotypic selection in transformed cells. Such vector sequences are well known for a variety of bacteria, yeast, and viruses. Useful expression vectors that can be used include, for example, segments of chromosomal, non-chromosomal and synthetic DNA sequences. "Expression vector" refers to a DNA construct containing a DNA sequence that is operably linked to a suitable control sequence capable of effecting the expression of the DNA encoding the polypeptide in a suitable host. The requirements are that the vectors are replicable and viable in the host cell of choice. Low- or high-copy number vectors may be used as desired.

Suitable vectors include, but are not limited to, derivatives of SV40 and pcDNA and known bacterial plasmids such as col EI, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2 m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. Yeast expression systems that can also be used in the present disclosure include, but are not limited to, the non-fusion pYES2 vector (Invitrogen), the fusion pYESHisA, B, C (Invitrogen), pRS vectors and the like. The control sequences of the vector include a promoter to effect transcription, an optional operator sequence to control such transcription, a sequence encoding suitable mRNA ribosome binding sites, and sequences that control termination of transcription and translation. The promoter may be any DNA sequence, which shows transcriptional activity in the host cell of choice and may be derived from genes encoding proteins either homologous or heterologous to the host cell. Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)], all is operably linked to the DNA encoding CFXTEN polypeptides. Promoters for use in bacterial systems can also contain a Shine-Dalgarno (S.D.) sequence, operably linked to the DNA encoding recombinant polypeptide polypeptides.

IX. Methods of Making the Recombinant Polypeptide and AAC Compositions

In another aspect, the disclosure relates to methods of making the recombinant polypeptide compositions at high fermentation expression levels of functional protein using an E. coli host cell, as well as providing expression vectors encoding the constructs useful in methods to produce the cytotoxically active polypeptide construct compositions at high expression levels.

In one embodiment, the method comprises the steps of 1) preparing the polynucleotide encoding the recombinant polypeptide or AAC of any of the embodiments disclosed herein, 2) cloning the polynucleotide into an expression vector, which can be a plasmid or other vector under control of appropriate transcription and translation sequences for high level protein expression in a biological system, 3) transforming an appropriate E. coli host cell with the expression vector, and 4) culturing the host cell in conventional nutrient media under conditions suitable for the expression of the recombinant polypeptide composition. Where desired, the E. coli host cell is BL21 Gold. By the method, the expression of the recombinant polypeptide or AAC results in fermentation titers of at least 0.1 g/L, or at least 0.2 g/L, or at least 0.3 g/L, or at least 0.5 g/L, or at least 0.6 g/L, or at least 0.7 g/L, or at least 0.8 g/L, or at least 0.9 g/L, or at least 1 g/L of the expression product of the host cell and wherein at least 70%, or at least 80%, or at least 90%, or at least 95%, or at least 97%, or at least 99% of the expressed protein are correctly folded. As used herein, the term "correctly folded" means that the binding moiety component of the composition has the ability to specifically bind its target ligand. In another embodiment, the disclosure provides a method for producing a recombinant polypeptide or AAC composition, the method comprising culturing in a fermentation reaction a host cell that comprises a vector encoding a polypeptide comprising the recombinant polypeptide or AAC composition under conditions effective to express the polypeptide product at a concentration of more than about 10 milligrams/gram of dry weight host cell (mg/g), or at least about 250 mg/g, or about 300 mg/g, or about 350 mg/g, or about 400 mg/g, or about 450 mg/g, or about 500 mg/g of said polypeptide when the fermentation reaction reaches an optical density of at least 130 at a wavelength of 600 nm, and wherein the binding moieties of the expressed protein are correctly folded. In another embodiment, the disclosure provides a method for producing a recombinant polypeptide composition or AAC, the method comprising culturing in a fermentation reaction a host cell that comprises a vector encoding a polypeptide comprising the recombinant polypeptide or AAC composition under conditions effective to express the polypeptide product at a concentration of more than about 10 milligrams/gram of dry weight host cell (mg/g), or at least about 250 mg/g, or about 300 mg/g, or about 350 mg/g, or about 400 mg/g, or about 450 mg/g, or about 500 mg/g of said polypeptide when the fermentation reaction reaches an optical density of at least 130 at a wavelength of 600 nm, and wherein the expressed polypeptide product is soluble.

The following are examples of compositions and evaluations of compositions of the disclosure. It is understood that various other embodiments may be practiced, given the general description provided above.

EXAMPLES

Example 1: Construction of ProTIA Construct with Anti-EpCAM-Anti-CD3-XTEN with Release Segment and XTEN The gene encoding anti-EpCAM/anti-CD3 tandem scFv followed with one of the multi-specific release segment sequences (BSRS-1, amino acid sequence LSGRSDNHSPLGLAGS (SEQ ID NO.: 927)) was synthesized at Genescript, which introduced NdeI and BsaI restriction sites that are compatible with the NdeI and BsaI sites in the pBR322-XTEN864 destination vector. Restriction digested gene fragments containing anti-EpCAM/anti-CD3 tandem scFv and the BSRS-1 were ligated into the pBR322-XTEN864 vector using T4 DNA ligase and transformed into BL21 Gold cells (New England Biolabs). Transformants were screened by DNA miniprep and the desired construct was confirmed by DNA sequencing. The final vector encodes the ProTIA molecule with the components (in the N- to C-terminus) of anti-EpCAM-anti-CD3 bispecific tandem scFv with BSRS-1 as release segment fused to XTEN_864 gene under the control of a PhoA promoter and STII secretion leader. The resulting construct is AC1278, with the DNA sequence and encoded amino acid sequence provided in Table 11.

Another anti-EpCAM anti-CD3-XTEN with Release Segment, designated AC1476 and with the DNA sequence and encoded amino acid sequence provided in Table 11 as well, was constructed in a similar manner into base vector pYS0044-XTEN864-H6 base vector. The underscored sequence represents signal peptide, which is cleaved off during secretion and is absent in the final mature protein.

Additional ProTIA variants were constructed using the same procedure and their amino acid sequences are listed in Table 14.

TABLE 11

DNA and amino acid sequence of AC1278 and AC1476 anti-EpCAM-anti-CD3-XTEN with Release Segment

| Construct Name | DNA Sequence | Amino Acid Sequence* |
|---|---|---|
| AC1278 | ATGAAGAAAAACATCGCTTTTCTTCTTGCATCTATGTTCGTTTTTTCTATTGCT<br>ACAAACGCGTACGCTCATCACCACCATCATCACCATCACGAACTGGTTATGACC<br>CAAAGCCCGAGCAGCCTGACCGTTACCGCGGGCGAAAAGGTTACCATGAGCTGC<br>AAAAGCAGCCAAAGCCTGCTGAACAGCGGCAACCAAAAGAACTACCTGACCTGG<br>TACCAACAGAAGCCGGGTCAGCCGCCGAAACTGCTGATCTACTGGGCGAGCACC<br>CGTGAGAGCGGCGTTCCGGACCGTTTTACCGGCAGCGGCAGCGGTACCGACTTT<br>ACCCTGACCATTAGCAGCGTGCAGGCGGAAGATCTGGCGGTGTACTATTGCCAA<br>AACGACTACAGCTACCCGCTGACCTTTGGTGCGGGCACCAAACTGGAGATCAAG<br>GGTGGCGGTGGCAGCGGCGGTGGTGGCAGCGGCGGTGGCAGCGAGGTTCAG<br>CTGCTGGAACAGAGCGGCGCGGAGCTGGTGCGTCCGGGTACCAGCGTTAAGATC<br>AGCTGCAAGGCGAGCGGTTATGCGTTCACCAACTACTGGCTGGGTTGGGTGAAG<br>CAACGTCCGGGTCACGGTCTGGAGTGGATCGGCGACATTTTCCCGGGCAGCGGT<br>AACATCCACTACAACGAGAAATTCAAGGGTAAAGCGACCCTGACCGCGGATAAA<br>AGCAGCAGCACCGCGTATATGCAGCTGAGCAGCCTGACCTTCGAAGATAGCGCG | MKKNIAFLLASMFVFSIAT<br>NAYAHHHHHHHELVMTQS<br>PSSLTVTAGEKVTMSCKSS<br>QSLLNSGNQKNYLTWYQQK<br>PGQPPKLLIYWASTRESGV<br>PDRFTGSGSGTDFTLTISS<br>VQAEDLAVYYCQNDYSYPL<br>TFGAGTKLEIKGGGSGGG<br>GSGGGGSEVQLLEQSGAEL<br>VRPGTSVKISCKASGYAFT<br>NYWLGWVKQRPGHGLEWIG<br>DIFPGSGNIHYNEKFKGKA<br>TLTADKSSSTAYMQLSSLT<br>FEDSAVYFCARLRNWDEPM |

TABLE 11-continued

DNA and amino acid sequence of AC1278 and AC1476 anti-EpCAM-anti-CD3-XTEN with Release Segment

| Construct Name | DNA Sequence | Amino Acid Sequence* |
|---|---|---|
| | GTTTACTTCTGCGCGTCTGCGTAACTGGGATGAACCGATGGATTACTGGGGT<br>CAGGGCACCACCGTGACCGTTAGCAGCGGTGGTGGCGGCAGCGATGTTCAGCTG<br>GTGCAAAGCGGTGCGGAAGTGAAAAAGCCGGGTGCGAGCGTGAAAGTTAGCTGC<br>AAAGCGAGCGGCTATACCTTCACCCGTTACACCATGCACTGGGTTCGTCAGGCG<br>CCGGGTCAGGGCCTGGAATGGATCGGCTACATCAACCCGAGCCGTGGCTATACC<br>AACTACGCGGATAGCGTGAAAGGTCGTTTCACCATTACCACCGACAAAAGCACC<br>AGCACCGCGTACATGGAACTGAGCAGCCTGCGTAGCGAGGATACCGCGACCTAC<br>TATTGCGCGCGTTACTATGATGACCACTACTGCCTGGACTATTGGGGCCAAGGT<br>ACCACCGTTACCGTGAGCAGCGGTGAAGGCACCAGCACCGGCAGCGGTGGTAGC<br>GGTGGTAGCGGCGGTGCGGATGACATCGTTCTGACCCAAAGCCCGGCGACCCTG<br>AGCCTGAGCCCGGGCGAGCGTGCGACCCTGAGCTGCCGTGCGAGCCAGAGCGTT<br>AGCTACATGAACTGGTACCAGCAAAAGCCGGGCAAAGCGCCGAAGCGTTGGATT<br>TATGATACCAGCAAGGTTGCGAGCGGTGTTCCGGCGCGTTTCAGCGGTAGCGGT<br>AGCGGCACCGATTATAGCCTGACCATTAACAGCCTGGAGGCGGAAGATGCGGCG<br>ACCTACTACTGCCAACAATGGAGCAGCAATCCGCTGACCTTCGGTGGTGGTACC<br>AAAGTTGAAATTAAGGGCACCGCCGAAGCAGCTAGCGCCTCTGGCCTGTCAGGT<br>CGTTCTGATAACCATTCCCCACTGGGTCTGGCTGGGTCTCCAGGTAGCCCAGCT<br>GGTAGCCCAACCTCTACCGAAGAAGGTACCTCTGAATCCGCTACTCCAGAATCC<br>GGTCCTGGTACTAGCACTGAGCCAAGCAGGTTCTGCTCCAGGCTCCCCGGCA<br>GGTAGCCCTACCTCTACCGAAGAGGGCACTAGCACCGAACCATCTGAGGGTTCC<br>GCTCCTGGCACCTCCACTGAACCGTCCGAAGGCAGTGCTCCGGGTACTTCCGAA<br>AGCGCAACTCCGGAATCCGGCCCTGGTTCTGAGCCTGCTACTTCCGGCTCTGAA<br>ACTCCAGGTAGCGAGCCAGCGACTTCTGGTTCTGAAACTCCAGGTTCACCGGCG<br>GGTAGCCCGACGAGCACGGAGGAAGGTACCTCTGAGTCGGCCACTCCTGAGTCC<br>GGTCCGGGCACGAGCACCGAGCCGAGCGAGGGTTCAGCCCCGGGTACCAGCACG<br>GAGCCGTCCGAGGGTAGCGCACCGGGTTCTCCGGCGGGCTCCCCTACGTCTACG<br>GAAGAGGGTACGTCCACTGAACCTAGCGAGGGCAGCGCGCCAGGCACCAGCACT<br>GAACCGAGCGAAGGCAGCGCACCTGGCACTAGCGAGTCTGCGACTCCGGAGAGC<br>GGTCCGGGTACGAGCACGGAACCAAGCGAAGGCAGCGCCCAGGTACCTCTGAA<br>TCTGCTACCCCAGAATCTGGCCCGGGTTCCGAGCCAGCTACCTCTGGTTCTGAA<br>ACCCCAGGTACTTCCACTGAACCAAGCGAAGGTAGCGCTCCTGGCACTTCTACT<br>GAACCATCCGAAGGTTCCGCTCCTGGTACGTCTGAAAGCTACCCCTGAAAGC<br>GGCCCAGGCACCTCTGAAAGCGCTACTCCTGAGAGCGGTCCAGGCTCTCCAGCA<br>GGTTCTCCAACCTCCACTGAAGAAGGCACCTCTGAGTCTGCTACCCCTGAATCT<br>GGTCCTGGCTCCGAACCTGCTACCTCTGGTTCCGAAACTCCAGGTACCTCGGAA<br>TCTGCGACTCCAGAATCTGGCCCGGGCACGAGCACGAGCGCTCGTGAGGGTAGC<br>CACCAGGTACCAGCACTGAGCCTTCTGAGGGCTCTGCACCGGGTACCTCCACG<br>GAACCTTCGGAAGGTTCTGCGCCGGGTACCTCCACTGAGCCATCCGAGGGTTCA<br>GCACCAGGTACTAGCACGGAACCGTCCGAGGGCTCTGCACCAGGTACGAGCACC<br>GAACCGTCGGAGGGTAGCGCTCCAGGCGGGCTCTCCGACAAGCACT<br>GAAGAAGGCACCAGCACCGAGCCGTCCGAAGGTTCCGCACCAGGTACAAGCAG<br>AGCGCGACTCCTGAATCTGGTCCGGGTAGCGAGCCTGCAACCAGCGGTTCTGAG<br>ACGCCGGGCACTTCCGAATCTGCGACCCCGGAGTCCGGTCCAGGTTCAGAGCCG<br>GCGCCAGCGCGTTCGGAAGCGCAGGGTAGCCCAGGGTCTGAATCAGCCACGCCGGAGTCT<br>GGTCCGGGTACCTCGACCGAACCAAGCGAAGGTTCGGCACCGGGTACTAGCGAG<br>AGCGCAACCCCTGAAAGCGGTCCGGGCAGCCCGGCAGGTTCTCCAACCAGCACC<br>GAAGAAGGTTCCCCTGCTGGTAGCCCGACCTCTACGGAGGAAGGTAGCCCTGCA<br>GGTTCCCCAACTTCTACTGAGGAAGGTACTTCTGAGTCCGCTACCCAGAAAGC<br>GGTCCTGGTACCTCCACTGAACCGTCTGAAGGCTCTGCACCAGGCACTTCTGAG<br>TCTGCTACTCCAGAAAGCGGCCCAGGTTCTGAACCAGCAACTTCTGGCTCTGAG<br>ACTCCAGGCACTTCTGAGTCCGCAACGCCTGAATCCGGTCCTGGTTCTGAACCA<br>GCTACTTCCGGCAGCGAAACCCCAGGTTCTCGTGCTGCACCAGAGTCT<br>GGTCCTGGTACTTCCACTGAGCCTAGCGAGGGTTCCGCACCAGGTTCTCCGGCT<br>GGTAGCCCGACCAGCACGGAGGAGGGTACGTCTGAATCTGCAACGCCGGAATCG<br>GGCCCAGGTTCGGAGCCTGCAACGTCTGGCAGCGAAACCCCGGGTACCTCCGAA<br>TCTGCTACACCGGAAAGCGGTCCTGGCAGCCCTGCTGGTTCTCAACCTCTACC<br>GAGGAGGGTTCACCGGCAGGTAGCCCGACTGACTGAAGAAGGTACTAGCACG<br>GAGCCGAGCGAGGGTAGTGCTCCGGGTACGAGCGAGAGCGCAACGCCAGAGAGC<br>GGTCCAGGCACCAGCGAATCGGCCACCCCTGAGAGCGGCCCAGGTACTTCTGAG<br>AGCGCCACTCCTGAATCCGGCCCTGGTAGCGAGCCGGCAACCTCCGGCTCAGAA<br>ACTCCTGGTTCGGAACCAGCGACCAGCGGTTCTGAACCTCCGGGTAGCCCGGCA<br>GGCAGCCCAACGAGCACCGAAGAGGGTACCAGCACGGAACCGAGCGAGGGTTCT<br>GCCCCGGGTACTTCCACCGAACCATCGGAGGGCTCTGCACCTGGTAGCGAACCT<br>GCGACGTCTGGTTCTGAAACGCCGGGTACCAGCGAAAGCGCTACCCCAGAATCC<br>GGTCCGGGCACTAGCACCGAGCCATCGGAGGGCTCCGCACCAGGT<br>(SEQ ID NO.: 928) | DYWGQGTTVTVSSGGGGSD<br>VQLVQSGAEVKKPGASVKV<br>SCKASGYTFTRYTMHWVRQ<br>APGQGLEWIGYINPSRGYT<br>NYADSVKGRFTITTDKSTS<br>TAYMELSSLRSEDTATYYC<br>ARYYDDHYCLDYWGQGTTV<br>TVSSGEGTSTGSGGSGGSG<br>GADDIVLTQSPATLSLSPG<br>ERATLSCRASQSVSYMNWY<br>QQKPGKAPKRWIYDTSKVA<br>SGVPARFSGSGSGTDYSLT<br>INSLEAEDAATYYCQQWSS<br>NPLTFGGGTKVEIKGTAEA<br>ASASGLSGRSDNHSPLGLA<br>GSPGSPAGSPTSEEGTSE<br>SATPESGPGTSTEPSEGSA<br>PGSPAGSPTSEEGTSTEP<br>SEGSAPGTSTEPSEGSAPG<br>TSESATPESGPGSEPATSG<br>SETPGSEPATSGSETPGSP<br>AGSPTSTEEGTSESATPES<br>GPGTSTEPSEGSAPGTSTE<br>PSEGSAPGSPAGSPTSTEE<br>GTSTEPSEGSAPGTSTEPS<br>EGSAPGTSESATPESGPGT<br>STEPSEGSAPGTSESATPE<br>SGPGSEPATSGSETPGTST<br>EPSEGSAPGTSTEPSEGSA<br>PGTSESATPESGPGTSESA<br>TPESGPGSPAGSPTSTEEG<br>TSESATPESGPGSEPATSG<br>SETPGTSESATPESGPGTS<br>TEPSEGSAPGTSTEPSEGS<br>APGTSTEPSEGSAPGTSTE<br>PSEGSAPGTSTEPSEGSAP<br>GTSTEPSEGSAPGSPAGSP<br>TSTEEGTSTEPSEGSAPGT<br>SESATPESGPGSEPATSGS<br>ETPGTSESATPESGPGSEP<br>ATSGSETPGTSESATPESG<br>PGTSTEPSEGSAPGTSESA<br>TPESGPGSPAGSPTSTEEG<br>SPAGSPTSTEEGSPAGSPT<br>STEEGTSESATPESGPGTS<br>TEPSEGSAPGTSESATPES<br>GPGSEPATSGSETPGTSES<br>ATPGSEPATSGSETP<br>GTSESATPESGPGTSTEPS<br>EGSAPGSPAGSPTSTEEGT<br>SESATPESGPGSEPATSGS<br>ETPGTSESATPESGPGSPA<br>GSPTSTEEGSPAGSPTSTE<br>EGTSTEPSEGSAPGTSESA<br>TPESGPGTSESATPESGPG<br>TSESATPESGPGSEPATSG<br>SETPGSEPATSGSETPGSP<br>AGSPTSTEEGTSTEPSEGS<br>APGTSTEPSEGSAPGSEPA<br>TSGSETPGTSESATPESGP<br>GTSTEPSEGSAPG<br>(SEQ ID NO.: 930) |
| AC1476 | ATGAAGAAAAACATCGCTTTTCTTCTTGCATCTATGTTCGTTTTTTCTATTGCT<br>ACAAACGCGTACGCTGATATTCAGATGACCCAATCGCCGTCGTCCTGTCAGCT<br>TCAGTCGGTGATCGTGTTACCATTACCTGTCGCTAACGAAATCCCTGCTGCAT<br>TCAAACGGTATTACCTATCTGTACTGGTATCAGCAAAAACCGGGCAAAGCGCCG<br>AAACTGCTGATCTACCAGATGTCGAATCTGGCCAGCGGTGTTCCGTCTCGTTTT<br>AGCTCTAGTGGTTCTGGCACCGATTTCACCCTGACGATTTCCTCACTGCAACCG<br>GAAGACTTTGCAACGTATTACTGCGCTCAGAACCTGGAAATCCCGCGTACCTTC | MKKNIAFLLASMFVFSIAT<br>NAYADIQMTQSPSSLSASV<br>GDRVTITCRSTKSLLHSNG<br>ITYLYWYQQKPGKAPKLLI<br>YQMSNLASGVPSRFSSSGS<br>GTDFTLTISSLQPEDFATY<br>YCAQNLEIPRTFGQGTKVE |

TABLE 11-continued

DNA and amino acid sequence of AC1278 and AC1476 anti-EpCAM-anti-CD3-
XTEN with Release Segment

| Construct Name | DNA Sequence | Amino Acid Sequence* |
|---|---|---|
| | GGTCAAGGCACGAAAGTCGAAATTAAAGGTGCAACGCCTCCGGAGACTGGTGCT<br>GAAACTGAGTCCCCGGGCGAGACGACCGGTGGCTCTGCTGAATCCGAACCACCG<br>GGCGAAGGCCAAGTGCAACTGGTTCAGAGCGGTCCGGGTCTGGTCCAACCGGGT<br>GGCAGTGTGCGTATTTCCTGCGCGGCCTCAGGTTACACCTTTACGAACTATGGC<br>ATGAATTGGGTGAAACAGGCCCCGGGTAAAGGCCTGGAATGGATGGGTTGGATC<br>AACACCTACACGGGCGAATCTACCTATGCAGATAGTTTCAAAGGCCGCTTTACC<br>TTCAGCCTGGACACGTCTGCTAGTGCAGCTTATCTGCAGATTAATAGCCTGCGT<br>GCGGAAGATACGGCCGTTTATTACTGTGCGCGCTTTGCAATCAAAGGCGACTAC<br>TGGGGCCAAGGCACCCTGCTGACCGTGTCCTCCGGTGGCGGCAGCGACATC<br>CAAATGACCCAGAGCCCGAGCAGCCTGAGCGCGAGCGTGGGCGACCGTGTTACC<br>ATCACCTGCCGTGCGAGCCAAGACATCCGTAACTACCTGAACTGGTATCAGCAA<br>AAGCCGGGTAAAGCGCCGAAGCTGCTGATCTACTATACCAGCCGTCTGGAGAGC<br>GGCGTGCCGAGCCGTTTCAGCGGTAGCGGTAGCGGTACCGACTACACCCTGACC<br>ATTAGCAGCCTGCAGCCGGAAGATTTCGCGACCTACTATTGCCAGCAGGGTAAC<br>ACCCTGCCGTGGACCTTTGGTCAAGGCACCAAAGTTGAGATTAAAGGCGCCACG<br>CCTCCGGAAACTGGTGCTGAGACGGAATCCCCTGGTGAAACCACTGGCGGTTCT<br>GCCGAATCTGAACCGCCTGGTGAAGGCGAGGTGCAGCTGGTTGAAAGCGGTGGC<br>GGTCTGGTGCAACCAGGCGGTAGCCTGCGTCTGAGCTGCGCGGCGAGCGGTTAC<br>AGCTTTACCGGTTATACCATGAACTGGGTTCGTCAAGCGCAGGTAAAGGTCTG<br>GAGTGGGTGGCGCTGATCAACCCGTACAAGGGTGTTAGCACCTATAACCAGAAG<br>TTCAAAGACCGTTTTACCATTAGCGTGGATAAGAGCAAAAACACCGCGTACCTG<br>CAAATGAACAGCCTGCGTGCGGAGGACACCGCTGTACTATTGCCGCGCGTAGC<br>GGTTACTATGGCGACAGCGACTGGTATTTTGATGTGGGGCCAAGGCACCCTG<br>GTTACCGTGAGCTCCGGCACCGCCGAAGCAGCTAGCGCCTCTGGCCTGTCAGGT<br>CGTTCTGATAACCATTCCCCACTGGGTCTGGCTGGGTCTCCAGGTAGCCCAGCT<br>GGTAGCCCAACCTCTACCGAAGAAGGTACCTCTGAATCCGCTACTCCAGAATCC<br>GGTCCTGGTACTAGCACTGAGCCAAGCGAAGGTTCTGCTCCAGGCTCCCCGGCA<br>GGTAGCCCTACCTCTACCGAAGAGGGCACTAGCACCGAACCATCTGAGGGTTCC<br>GCTCCTGGCACCTCCACTGAACCGTCCGAAGGCAGTGCTGCGACTCCGGAGAGC<br>GGTCCGGGTACGAGCGGAACCAAGCGAAGGCAGCGCCCCAGGTACCTCTGAA<br>AGCGCAACTCCGGAATCCGGCCCTGGTTCTGAGCGCTGCTACTTCCGGCTCTGAA<br>ACTCCAGGTAGCGAGCCAGCGACTTCTGGTTCTGAAACTCCAGGTTCACCGGCG<br>GGTAGCCCGACGAGCACGGAGGAAGGTACCTCTGAGTCGGCCACTCCTGAGTCC<br>GGTCCGGGCACGAGCACCGAGCCGAGCGAGGGTTCAGCCCCGGGTACCAGCACG<br>GAGCCGTCCGAGGGTAGCGCACCGGGTTCTCCGGCGGGCTCCCCTACGTCTACG<br>GAAGAGGGTACGTCCACTGAACCTAGCGAGGGCAGCGCGCCAGGCACCAGCACT<br>GAACCGAGCGAAGGCAGCGCACCTGGCACTAGCGAGTCTGCGACTCCGGAGAGC<br>GGTCCGGGTACGAGCGGAACCAAGCGAAGGCAGCGCCCCAGGTACCTCTGAA<br>TCTGCTACCCCAGAATCTGGCCCGGGTTCCGAGCCAGCTACCTCTGGTTCTGAA<br>ACCCCAGGTACTTCCACTGAACCAAGCGAAGGTAGCGCTCCTGGCACTTCTACT<br>GAACCATCCGAAGGTTCCGCTCCTGGTACGTCTGAAAGCGCTACCCCTGAAAGC<br>GGCCCAGGCACCTCTGAAAGCGCTACTCCTGAGAGCGGTCCAGGCTCTCCAGCA<br>GGTTCTCCAACCTCCACTGAAGAAGGCACCTCTGAGTCTGCTACCCCTGAATCT<br>GGTCCTGGCTCCGAACCTGCTACCTCTGGTTCCGAACTCCAGGTACCTCGGAA<br>TCTGCGACTCCGGAATCTGGCCCGGGCACGAGCACGGAGCCGTCTGAGGGTAGC<br>GCACCAGGTACCAGCACTGAGCCTTCTGAGGGCTCTGCACCGGGTACCTCCACG<br>GAACCTTCGGAAGGTTCTGCGCCGGGTACCTCCACTGAGCCATCCGAGGGTTCA<br>GCACCAGGTACTAGCACGGAACCGTCCGAGGGCTCTGCACCAGGTACGAGCACC<br>GAACCGTCGGAGGGTAGCGCTCCAGGTAGCCCAGCGGGCTCTCCGACAAGCACC<br>GAAGAAGGCACCAGCACCGAGCCGTCCGAAGGTTCCGCACCAGGTACAAGCGAG<br>AGCGCGACTCCTGAATCTGGCCCGGGCTCCGAACCAGCGGTTCTGAG<br>ACGCCGGGCACTTCCGAATCTGCGACCCCGGAGTCCGGTCCAGGTTCAGAGCCG<br>GCGACGAGCGGTTCGGAAACGCCGGGTACGTCTGAATCAGCCACGCCGGAGTCT<br>GGTCCGGGTACCTCGACCGAACCAAGCGAAGGTTCGGCACCGGGTACTAGCGAG<br>AGCGCAACCCCTGAAAGCGGTCCGGGCAGCCCGGCAGGTTCTCCAACCAGCACC<br>GAAGAAGGTTCCCCTGCTGGTAGCCCGACCTCTACGGAGGAAGGTAGCCCTGCA<br>GGTTCCCCAACTTCTACTGAGGAAGGTACTTCTGAGTCCGCTACCCCAGAAAGC<br>GGTCCTGGTACCTCCACTGAACCGTCTGAAGGCTCTGCACCAGGCACTTCTGAG<br>TCTGCTACTCCAGAAAGCGGCCCAGGTTCTGAACCAGCAACTTCTGGCTCTGAG<br>ACTCCAGGCACTTCTGAGTCCGCAACGCCTGAATCCGGTCCTGGTTCTGAACCA<br>GCTACTTCCGGCAGCGAAACCCCAGGTACCTCTGAGTCTGCGACTCCAGAGTCT<br>GGTCCTGGTACTTCCACTGAGCCTAGCGAGGGTTCCGCACCAGGTTCTCCGGCT<br>GGTAGCCCGACCAGCACGGAGGAGGGTACGTCTGAATCTGCAACGCCGGAATCG<br>GGCCCAGGTTCGGAGCCTGCAACGTCTGGCAGCGAAACCCCGGGTACCTCCGAA<br>TCTGCTACACCGGAAAGCGGTCCTGGCAGCCCTGCTGGTTCTCCAACCTCTACC<br>GAGGAGGGTTCACCGGCAGGTAGCCCGACTAGCACTGAAGAAGGTACTAGCACG | IKGATPPETGAETESPGET<br>TGGSAESEPPGEGQVQLVQ<br>SGPGLVQPGGSVRISCAAS<br>GYTFTNYGMNWVKQAPGKG<br>LEWMGWINTYTGESTYADS<br>FKGRFTFSLDTSASAAYLQ<br>INSLRAEDTAVYYCARFAI<br>KGDYWGQGTLLTVSSGGGG<br>SDIQMTQSPSSLSASVGDR<br>VTITCRASQDIRNYLNWYQ<br>QKPGKAPKLLIYYTSRLES<br>GVPSRFSGSGSGTDYTLTI<br>SSLQPEDFATYYCQQGNTL<br>PWTFGQGTKVEIKGATPPE<br>TGAETESPGETTGGSAESE<br>PPGEGEVQLVESGGGLVQP<br>GGSLRLSCAASGYSFTGYT<br>MNWVRQAPGKGLEWVALIN<br>PYKGVSTYNQKFKDRFTIS<br>VDKSKNTAYLQMNSLRAED<br>TAVYYCARSGYYGDSDWYF<br>DVWGQGTLVTVSSGTAEAA<br>SASGLSGRSDNHSPLGLAG<br>SPGSPAGSPTSTEEGTSES<br>ATPESGPGTSTEPSEGSAP<br>GSPAGSPTSTEEGTSTEPS<br>EGSAPGTSTEPSEGSAPGT<br>SESATPESGPGSEPATSGS<br>ETPGSEPATSGSETPGSPA<br>GSPTSTEEGTSESATPESG<br>PGTSTEPSEGSAPGTSTEP<br>SEGSAPGSPAGSPTSTEEG<br>TSTEPSEGSAPGTSTEPSE<br>GSAPGTSESATPESGPGTS<br>TEPSEGSAPGTSESATPES<br>GPGSEPATSGSETPGTSTE<br>PSEGSAPGTSTEPSEGSAP<br>GTSESATPESGPGTSESAT<br>PESGPGSPAGSPTSTEEGT<br>SESATPESGPGSEPATSGS<br>ETPGTSESATPESGPGTST<br>EPSEGSAPGTSTEPSEGSA<br>PGTSTEPSEGSAPGTSTEP<br>SEGSAPGTSTEPSEGSAPG<br>TSTEPSEGSAPGSPAGSPT<br>STEEGTSTEPSEGSAPGTS<br>ESATPESGPGSEPATSGSE<br>TPGTSESATPESGPGSEPA<br>TSGSETPGTSESATPESGP<br>GTSTEPSEGSAPGTSESAT<br>PESGPGSPAGSPTSTEEGS<br>PAGSPTSTEEGSPAGSPTS<br>TEEGTSESATPESGPGTST<br>EPSEGSAPGTSESATPESG<br>PGSEPATSGSETPGTSESA<br>TPESGPGSEPATSGSETPG<br>TSESATPESGPGTSTEPSE<br>GSAPGSPAGSPTSTEEGTS<br>ESATPESGPGSEPATSGSE<br>TPGTSESATPESGPGSPAG<br>SPTSTEEGSPAGSPTSTEE<br>GTSTEPSEGSAPGTSESAT<br>PESGPGTSESATPESGPGT<br>SESATPESGPGSEPATSGS<br>ETPGSEPATSGSETPGSPA |

TABLE 11-continued

DNA and amino acid sequence of AC1278 and AC1476 anti-EpCAM-anti-CD3-XTEN with Release Segment

| Construct Name | DNA Sequence | Amino Acid Sequence* |
|---|---|---|
| | GAGCCGAGCGAGGGTAGTGCTCCGGGTACGAGCGAGAGCGCAACGCCAGAGAGC GGTCCAGGCACCAGCGAATCGGCCACCCCTGAGAGCGGCCAGGTACTTCTGAG AGCGCCACTCCTGAATCCGGCCCTGGTAGCGAGCCGGCAACCTCCGGCTCAGAA ACTCCTGGTTCGGAACCAGCGACCAGCGGTTCTGAAACTCCGGGTAGCCCGGCA GGCAGCCCAACGAGCACCGAAGAGGGTACCAGCACGGAACCGAGCGAGGGTTCT GCCCCGGGTACTTCCACCGAACCATCGGAGGGCTCTGCACCTGGTAGCGAACCT GCGACGTCTGGTTCTGAAACGCCGGGTACCAGCGAAAGCGCTACCCCAGAATCC GGTCCGGGCACTAGCACCGAGCCATCGGAGGGCTCCGCACCAGGTCACCATCAT CACCATCAC (SEQ ID NO.: 929) | GSPTSTEEGTSTEPSEGSA PGTSTEPSEGSAPGSEPAT SGSETPGTSESATPESGPG TSTEPSEGSAPGHHHHHH (SEQ ID NO.: 931) |

*underlined peptide represents the signal peptide

Example 2: Production of Uncleaved and Cleaved His8-aEpCAM-aCD3-BSRS1-XTEN864 from E. coli Fermentation Culture 1) Expression and Purification of his(8)-aEpCAM-aCD3-BSRS1-XTEN_AE864 from E. coli Fermentation Culture The fusion protein AC1278 (MKKNIAFLLASMFVFSI-ATNAYA-His(8)-aEpCAM-aCD3-BSRS1-XTEN_AE864; SEQ ID NO: 930) was expressed in a proprietary E. coli AmE098 strain. A 10 L fermentation culture was grown at 37° C. and temperature shifted to 26° C. following depletion of the salt feed. During harvest, fermentation whole broth was centrifuged to pellet the cells. The supernatant was collected, and acid flocculation was then used to reduce endotoxin and host cell protein contamination. Using 1 M acetic acid, the supernatant pH was gradually lowered to pH 4.5 and left to incubate at room temperature for 30 minutes. The pH was then raised back to pH 7.5 using 2M NaOH and held overnight at 4° C. On the following day, the supernatant was 0.20 µm filtered using a 3M LifeAssure filter capsule.

To ensure N-terminal integrity at the His affinity tag, immobilized-metal affinity chromatography was used as the first capture step. Five 10-mL RedisepRf 25 G column housings (Teledyne Isco) were packed with 10 mL of ToyoPearl-AF-Chelate 650M resin (TOSOH Biosciences). The columns were sanitized with 0.5M NaOH, thoroughly rinsed with distilled water, and then charged with 0.1M $Ni_2SO_4$, and equilibrated with 5 column volumes (CVs) of equilibration buffer (20 mM Tris, 250 mM NaCl, pH 7.5). Due to Triton X-114's cloud point of 23° C., Triton Wash buffer (20 mM Tris, 100 mM NaCl, 0.1% Triton X-114, pH 7.5) and Wash 2 buffer (20 mM Tris, 100 mM NaCl, pH 7.5) were prepared in advance, stored at 4° C., and kept on ice during use. After column equilibration, the supernatant was loaded to the column. Following 3 CVs of equilibration buffer as chase, the column was washed with 10 CVs of cold Triton Wash buffer to lower endotoxin, followed by 10 CVs of cold Wash 2 buffer to remove Triton X-114. Protein was then eluted from the column with 3 CVs of elution buffer (20 mM Tris, 100 mM NaCl, 150 mM imidazole, pH 7.5), and 1 CV fractions (10 mL) were collected. To reduced protein oxidation, 5 mM EDTA was added to each elution. The load, flowthrough, and elutions were analyzed by non-reducing 4-12% Bis-Tris SDS-PAGE and Coomassie staining. Based on the gel, elution CV1 and CV2 were saved for further processing. (FIG. 14A)

Hydrophobic interaction chromatography (HIC) was chosen as the subsequent polishing step. Two 20-mL RedisepRf 25 G column housings (Teledyne Isco) were packed with 20 mL of Toyopearl-Phenyl-650M resin (TOSOH Biosciences). The columns were sanitized with 0.5M NaOH, thoroughly rinsed with distilled water, and equilibrated with 5 CVs of Buffer A (20 mM Tris, 1M $(NH_4)_2SO_4$, pH 7.5). Elution buffers at 75% Buffer A, 50% Buffer A, and 25% Buffer A were prepared in advance by mixing appropriate volumes of Buffer A and Buffer B (20 mM Tris, pH 7.5). IMAC elutions CV1 and 2 were pooled together from the previous column step, and ammonium sulfate was added to a final concentration of 1M before loading to the pre-equilibrated Phenyl columns. After loading and chasing with 3 CVs of Buffer A, the column was eluted with 3 CVs each of 75% Buffer A, 50% Buffer A, 25% Buffer A, and 0% Buffer A. The load, flowthrough, and elutions were analyzed by non-reducing 4-12% Bis-Tris SDS-PAGE and Coomassie staining. Based on the gel, wash and elutions CV1-2 at 750 mM $(NH_4)_2SO_4$ (boxed) were pooled for further processing (FIG. 14B).

To ensure C-terminal integrity of XTEN and to further lower endotoxin, anion exchange chromatography was chosen as the final polishing step. A XK16 column housing on AKTApurifier was packed with 5 mL of Capto Q Impress resin (GE Healthcare), sanitized with 0.5M NaOH, thoroughly rinsed with distilled water, stripped with 2 CVs of Buffer B (20 mM Tris, 500 mM NaCl, pH 7.5), and equilibrated with 5 CVs of Buffer A (20 mM Tris pH 7.5). The HIC elution pool was diluted 4 fold before loading to the column. The column was then washed with 3 CVs of 30% Buffer B and eluted in a gradient of 30% to 70% Buffer B over 15 CVs. Elutions were collected in ½ CV (2.5 mL) fractions. The load, flowthrough, and elutions were then analyzed by non-reducing SDS-PAGE and Coomassie staining to determine fractions to pool for formulation (FIG. 14C).

2) Formulation and Characterization

Desired elution fractions (boxed in FIG. 14C) were concentrated and buffer exchanged into 50 mM Tris, 150 mM NaCl, pH 7.5. Formulated product was 0.2 µm sterile filtered. Lot release to determine product quality involved size exclusion chromatography analysis and SDS-PAGE analysis. For SEC analysis, 10 µg of formulated product was injected to an analytical SEC column, confirming >95% monomeric product. (FIG. 15A). SDS-PAGE analysis was conducted by loading 5 µg of formulated product to a 4-12% Bis-Tris gel and staining with Coomassie Blue. The product purity was >90% (FIG. 15B).

3) Enzyme Activation and Storage

Recombinant mouse MMP-9 was supplied as zymogen from R&D Systems and required activation by 4-aminophenylmercuric acetate (APMA). APMA was first dissolved in 0.1M NaOH to a final concentration of 10 mM before the pH was readjusted to neutral using 0.1N HCl. Further dilution of the APMA stock to 2.5 mM was done in 50 mM Tris, 150 mM NaCl, 10 mM $CaCl_2$), pH 7.5. To activate pro-MMP, 1 mM APMA and 100 ug/mL of pro-MMP-9 were incubated at 37° C. for 3 hours. Activated enzyme added to a final concentration of 50% glycerol could then be stored at −20° C. for several weeks.

4) MMP-9 Digestion of His(8)-aEpCAM-aCD3-BSRS1-XTEN864

To produce cleaved aEpCAM-aCD3 ProTIA-A, 9.12 mg of formulated His(8)-aEpCAM-aCD3-BSRS1-XTEN864 (ProTIA-X) was incubated for 2 hours at 37° C. in a reaction mixture containing 10 mM $CaCl_2$) and a 1:2237 enzyme-to-substrate molar ratio of active recombinant mouse MMP-9 (R&D Systems). To confirm specific digestion at BSRS1, 5 µg of undigested and MMP-9 digested product were run on 4-12% Bis-Tris SDS-PAGE, followed by staining by Coomasie Blue. Use of Coomassie Blue staining allowed visualization of the full-length His8-aEpCAM-aCD3-BSRS1-XTEN864 (ProTIA-X) before MMP-9 digestion and the His8-aEpCAM-aCD3 cleaved fragment (ProTIA-A) after MMP-9 digestion (FIG. 16A).

5) Purification of Cleaved His(8)-aEpCAM-aCD3 ProTIA-A Following MMP-9 Digestion Following confirmation of MMP-9 digestion at BSRS1, immobilized-metal affinity chromatography was used to remove MMP-9. A 5-mL polypropylene column housing (ThermoScientific) was packed with 2 mL of ToyoPearl-AF-Chelate 650M resin (TOSOH Biosciences). The column was equilibrated with 5 CVs of equilibration buffer (20 mM Tris, 250 mM NaCl, pH 7.5). The digestion mixture was then loaded to the column. After loading and chasing with 1 CV of equilibration buffer, the column was washed with 3 CVs of equilibration buffer. Protein was eluted from the column with 3 CVs of elution buffer (20 mM Tris, 100 mM NaCl, 150 mM imidazole, pH 7.5), and 1 CV fractions (2 mL) were collected. The load, flow-through, and elutions were analyzed by non-reducing 4-12% Bis-Tris SDS-PAGE and Coomassie straining to determine elutions containing ProTIA-A (FIG. 16B).

6) Formulation and Characterization of Cleaved His(8)-aEpCAM-aCD3

Desired elutions (boxed in FIG. 16B) were concentrated and buffer exchanged into 50 mM Tris, 150 mM NaCl, pH 7.5. Lot release to determine product quality involved size exclusion chromatography analysis and SDS-PAGE analysis. For SEC analysis, 10 µg of product was injected to an analytical SEC column, confirming >95% monomeric product (FIG. 17A). For SDS-PAGE analysis, 5 µg of product was loaded on a 4-12% Bis-Tris gel, confirming >90% product purity (FIG. 17B).

Example 3: Production of Uncleaved and Cleaved AC1476 aEpCAM-aCD3-BSRS1-XTEN_AE864-His(6) from *E. coli* Fermentation Culture 1) Expression and Purification of AC1476 aEpCAM-aCD3-BSRS1-XTEN_AE864-his(6) from *E. coli* Fermentation Culture The fusion protein AC1476 (MKKNIAFLLASMFVFSI-ATNAYA-aEpCAM-aCD3-BSRS1-XTEN_AE864-His(6); SEQ ID NO: 931) was expressed in a proprietary *E. coli* AmE097 strain. A 10 L fermentation culture was grown at 37° C. and temperature shifted to 28° C. after depletion of the salt feed. During harvest, fermentation whole broth was centrifuged to pellet the cells. The supernatant was 0.20 µm filtered using a 3M LifeAssure filter capsule. A XK50 housing column was packed with 100 mL of Toyopearl-AF-Chelate-650M resin (TOSOH Biosciences) and connected to a peristaltic pump at 4° C. The column was sanitized with 0.5M NaOH, thoroughly rinsed with distilled water, charged with 0.1M $NiSO_4$, and equilibrated with 5 CVs of equilibration buffer (20 mM Tris, 250 mM NaCl, pH 7.5). After column equilibration, the supernatant was loaded to the column, followed by Triton Wash, Wash 2, and elution similar to the process described above in Example 2-1. Elutions were collected in ¼ CV (25 mL) fractions and EDTA was added to a final concentration of 5 mM to chelate free nickel. The load, flowthrough, and elutions were analyzed by non-reducing 4-12% Bis-Tris SDS-PAGE and Coomassie staining. Based on the gel, elutions 2-5 (boxed) were saved for further processing. (FIG. 18A)

Hydrophobic interaction chromatography (HIC) was chosen as the subsequent polishing step. A XK24 housing column on AKTApurifier was packed with 50 mL of Toyopearl-Phenyl-650M resin (TOSOH Biosciences). The column was sanitized with 0.5M NaOH, thoroughly rinsed with distilled water, and equilibrated with 5 CVs of Buffer A (20 mM Tris, 1M $(NH_4)_2SO_4$, pH 7.5). Desired IMAC elutions were pooled together from the previous column step, and ammonium sulfate was added to a final concentration of 1M before loading to the column. Elutions were collected in 12 CV (25 mL) fractions in a gradient from 100% to 50% Buffer A over 10 CVs. The load, flowthrough, and elutions were analyzed by non-reducing 4-12% Bis-Tris SDS-PAGE and Coomassie staining. Based on the gel, elutions boxed were pooled for further processing (FIG. 18B).

Anion exchange chromatography was chosen as the final polishing step. A XK24 housing column was packed with 30 mL Capto Q Impress resin (GE Healthcare), sanitized with 0.5M NaOH, thoroughly rinsed with distilled water, stripped with 2 CVs of Buffer B (20 mM Tris, 500 mM NaCl, pH 7.5), and equilibrated with 5 CVs of Buffer A (20 mM Tris, pH 7.5). The elution pool was buffer exchanged through a Pellicon XL Ultrafiltration module Biomax 10 kDa into 20 mM Tris pH 7.5 until the permeate had a conductivity of 8 ms/cm. The permeate was loaded to the Capto Q Impress column, and the column was then washed with 3 CVs of 10% and 20% Buffer B. Elutions were collected in ¼ CV (7.5 mL) fractions in a gradient from 20% to 70% Buffer B over 10 CVs. The load, flowthrough, and elutions were analyzed by non-reducing 4-12% Bis-Tris SDS-PAGE and Coomassie staining. Based on the gel, selected elutions (boxed) were pooled for formulation (FIG. 18C).

2) Formulation and Characterization of aEpCAM-aCD3-BSRS1-XTEN864-His(6)

Desired elutions were concentrated and buffer exchanged into 50 mM Tris, 150 mM NaCl, pH 7.5. Lot release to determine product quality was performed following protocol established in Example 2 for SEC analysis (FIG. 19A) and SDS-PAGE (FIG. 19B). Additionally, 2 µg was loaded to a 4-12% Bis-Tris non-reducing SDS-PAGE gel, with subsequent silver staining (FIG. 19C). The results of SEC were also used to determine the apparent molecular weight and apparent molecular weight factor (relative to actual molecular weight) and the hydrodynamic radius of the aEpCAM-aCD3-BSRS1-XTEN864-His(6). The apparent molecular weight determined was 1.7 MDa, which would result in an apparent molecular weight factor of 12.3 and a calculated hydrodynamic radius of 10.8 nm.

To further prove the identity of the molecule, electrospray ionization mass spectrometry (ESI-MS) was performed and the experimental mass was determined to be 138,652 Da, with ΔMass of +1 Da when compared to theoretical molecular weight of 138,651 Da (FIG. 20A). For analytical cation exchange chromatography, 10 µg of sample was loaded onto Agilent Bio SCX NP3 with mobile phase A 20 mM sodium acetate, pH 4.5 and mobile phase B 20 mM sodium acetate, 1 M sodium chloride, pH 4.5. A linear gradient of 0-100% B was applied during the course of 20 minutes and only one single major peak was detected (FIG. 20B).

4) MMP-9 Digestion of aEpCAM-aCD3-BSRS1-XTEN864-His(6)

Following MMP-9 activation and digestion protocol described in Example 2, 20 mg of aEpCAM-aCD3-BSRS1-XTEN864-His(6) (ProTIA-X) was digested, however using only 1:6000 molar enzyme-to-substrate molar ratio of active recombinant mouse MMP-9. Undigested and digested products were analyzed by SDS-PAGE (FIG. 21A).

5) Purification of Cleaved aEpCAM-aCD3-BSRS1-XTEN864-His(6) Following MMP-9 Digestion Following confirmation of MMP-9 digestion at BSRS1, anion exchange chromatography was used to remove cleaved free XTEN and uncleaved ProTIA-X. Two 5-ml polypropylene column housings (ThermoScientific) were packed with 3 mL each of MacroCap Q resin (GE Healthcare), sanitized with CIP (0.5M NaOH, 1M NaCl), thoroughly rinsed with distilled water, stripped with 2 CVs of Buffer B (20 mM Tris, 500 mM NaCl, PH 7.5), and equilibrated with 5 CVs of Buffer A (20 mM Tris, pH 7.5). The digestion mixture was loaded to the column. After loading and chasing with 1 CV of Buffer A, the column was eluted with 2 CVs each of 150 mM, 200 mM, 250 mM, 300 mM, and 500 mM NaCl. The load, flowthrough, and elutions were analyzed by 4-12% Bis-Tris SDS-PAGE and Coomassie straining to determine fractions containing ProTIA-A (FIG. 21B).

6) Formulation and characterization of cleaved aEpCAM-aCD3 Desired ProTIA-A fractions were concentrated and buffer exchanged into 50 mM Tris, 150 mM NaCl, pH 7.5. Lot release to determine product quality was performed following protocol established in Example 2 for SEC analysis (FIG. 22A) and SDS-PAGE (FIG. 22B). Additionally, 2 µg was loaded to a 4-12% Bis-Tris non-reducing SDS-PAGE gel, with subsequent silver staining (FIG. 22C). The results of SEC were also used to determine the apparent molecular weight and apparent molecular weight factor (relative to actual molecular weight) and the calculated hydrodynamic radius of the aEpCAM-aCD3. The apparent molecular weight determined was 39.8 kDa (the latter being about 23-fold less than that of the intact construct, above), which would give apparent molecular weight factor of 0.7 (the latter being about 17-fold less than that of the intact construct, above) and a hydrodynamic radius of 2.3 nm (the latter being about 5-fold less than that of the intact construct, above).

To further prove the identity of the molecule, electrospray ionization mass spectrometry (ESI-MS) was performed and the experimental mass was determined to be 58,071 Da, with AMass of +4 Da when compared to theoretical molecular weight of 58,067 Da (FIG. 23A). Analytical cation exchange chromatography (FIG. 23B) using a protocol previously described in 2) also confirmed the homogeneity of the sample.

Example 4: EpCAM Binding Assays of Anti-EpCAM×Anti-CD3 Protease Triggered Immune Activator (ProTIA) Composition The binding capability of anti-EpCAM×anti-CD3 ProTIA composition was verified with an EpCAM/peroxidase-conjugated protein-L sandwich ELISA. In the ELISA binding assay, recombinant human EpCAM (rhEpCAM) (Sino BiologicalR&D Systems cat #10694-H08H960-EP-50) was coated on a 96-well, flat-bottomed plate at a concentration of 0.1 microg/100 microL. After overnight incubation at 4° C., the assay plate was washed and blocked with 3% bovine serum albumin (BSA) for 1 h at room temperature. The plate was washed again followed by the introduction of a dose range of non-cleavable anti-EpCAM×anti-CD3 ProTIA (i.e., a ProTIA without the release segment cleavage sequence and AC1484, a ProTIA chimeric polypeptide assembly composition) and protease-treated and protease-untreated anti-EpCAM×anti-CD3 ProTIA (AC1476). The dose range utilized for non-cleavable and protease-treated and untreated ProTIA was 0.0006 to 5 nM, achieved with a 1:6 fold serial dilution scheme from a starting concentration of 5 nM. The plate was allowed to incubate with shaking for 1 h at room temperature to allow the non-cleavable, protease-cleaved and uncleaved ProTIA to bind to the rhEpCAM coated on the plate. Unbound components were removed with a wash step and a peroxidase-conjugated protein L (PierceThermoFisher Scientific cat #32420) was added. After an appropriate incubation period that allowed protein-L to bind to the kappa light of the scFvs, any unbound reagent was removed by a wash step followed by the addition of tetramethylbenzidine (TMB) substrate to each well. TMB is a chromogenic substrate of peroxidase. After desired color intensity was reached, 0.2 N sulfuric acid was added to stop the reaction and absorbance (OD) was measured at 450 nm using a spectrophotometer. The intensity of the color is proportional to the concentration of non-cleavable, protease-treated and untreated anti-EpCAM×anti-CD3 ProTIA captured by the rhEpCAM/protein-L sandwich ELISA. The intensity of the color produced (measured OD) was plotted against protein concentration; and the concentration of non-cleavable, protease-cleaved and uncleaved anti-EpCAM×anti-CD3 ProTIA that gave half-maximal response ($EC_{50}$) was derived with a 4-parameter logistic regression equation using GraphPad prism software.

Figure 24:
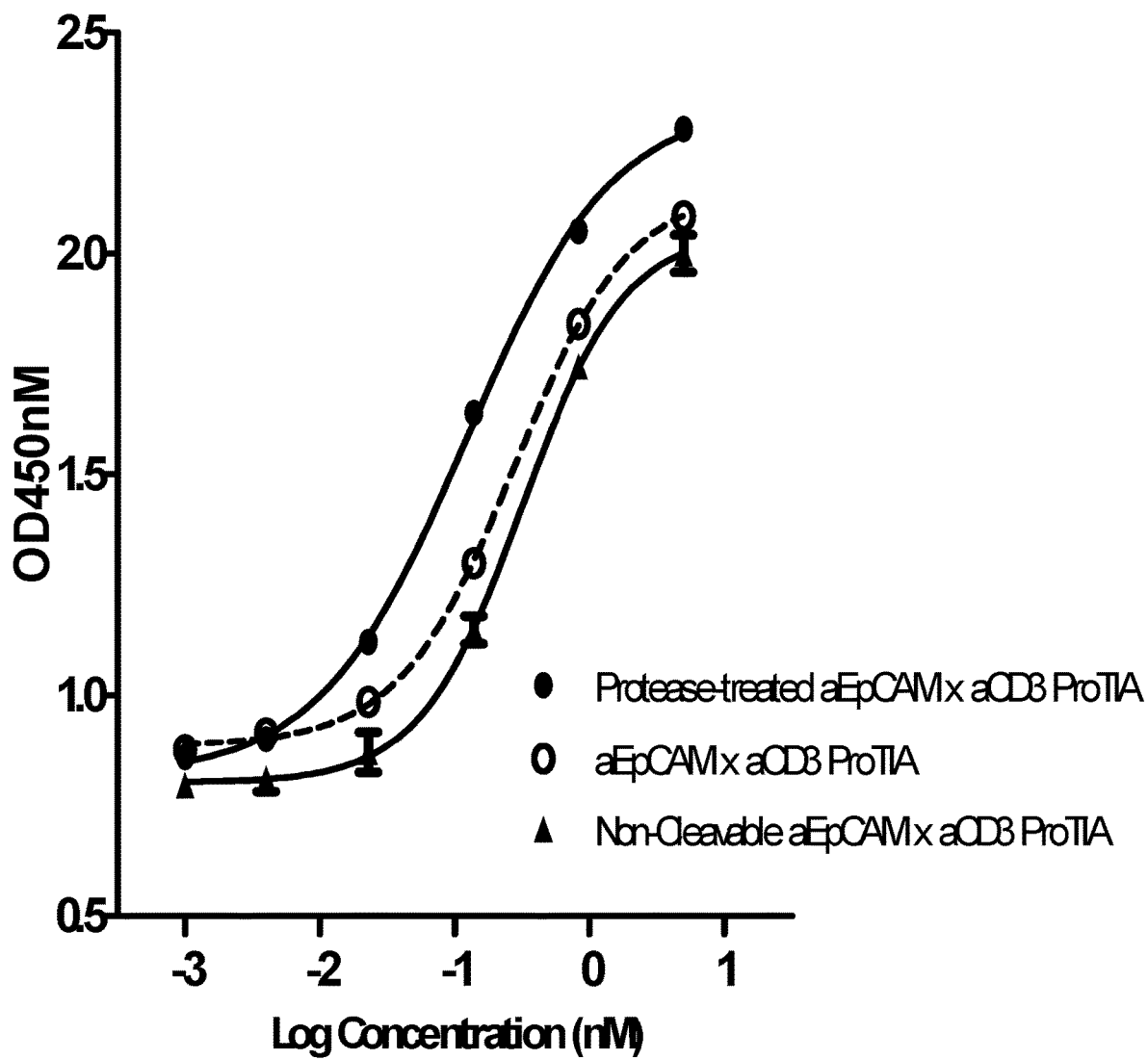
FIG. 24 shows binding of protease-treated and untreated anti-EpCAM×anti-CD3 ProTIA for its ligand, as described in Example 4.

As shown in FIG. 24, the non-cleavable anti-EpCAM×anti-CD3 ProTIA has a binding activity similar to that of protease-untreated anti-EpCAM×anti-CD3 bispecific ProTIA molecule each bearing an $EC_{50}$ of 320 pM and 280 pM respectively. The protease-treated ProTIA has the strongest binding activity at $EC_{50}$ of 120 pM for the rhEpCAM ligand compared to the intact protease-untreated bispecific molecule or the non-cleavable ProTIA molecule. The data suggest that the presence of XTEN864 hindered the binding of the anti-EpCAM moiety for its ligand by at least 2.3-fold.

Example 5: Cell Binding Assessed by Flow Cytometry

Bispecific binding of the anti-EpCAM×anti-CD3 ProTIA composition is also evaluated by fluorescence-activated cell sorting (FACS)-based assays utilizing CD3 positive human Jurkat cells and EpCAM positive human cells selected from SW480, HCT-116, Kato III, MDA-MB-453, MCF-7, MT3, SK-Br-3, SK-OV-3, OVCAR-3, BT-474, HPAF-II, JIMT-1, MDA-MB-436, NCI-H322, NCI-H660, NCI-H69 and PC3. $CD3^+$ and $EpCAM^+$ cells are incubated with a dose range of untreated anti-EpCAM×anti-CD3 ProTIA, protease-treated anti-EpCAM×anti-CD3 ProTIA, and anti-CD3 scFv and anti-EpCAM scFv positive controls for 30 min at 4° C. in FACS buffer containing PBS with 1% BSA and 0.05% sodium azide. After several washes in FACS buffer to remove unbound test material, cells are incubated with FITC-conjugated anti-His tag antibody (Abcam cat #ab1206) for 30 min at 4° C. Unbound FITC-conjugated antibody is removed by several washes with FACS buffer and cells resuspended in FACS buffer for acquisition on a FACS Calibur flow cytometer (Becton Dickerson) or equivalent flow cytometry instrument. All flow cytometry data are analyzed with FlowJo software (FlowJo LLC) or equivalent.

While anti-EpCAM scFv is not expected to bind to Jurkat cells, anti-CD3 scFv, untreated anti-EpCAM×anti-CD3 ProTIA and protease-treated anti-EpCAM×anti-CD3 ProTIA are all expected to bind to Jurkat cells as indicated by an increase in fluorescence intensity when compared to Jurkat cells incubated with FITC-conjugated anti-His tag antibody alone. Similarly, anti-EpCAM scFv, protease-treated and untreated anti-EpCAM×anti-CD3 ProTIA are all expected to bind to EpCAM positive cells, while anti-CD3 scFv is not expected to bind to EpCAM positive cells. It is expected that these data will reflect the bispecific binding ability of the anti-EpCAM×anti-CD3 ProTIA composition to recognize both the CD3 and EpCAM antigen expressed respectively on Jurkat and the panel of EpCAM expressing human cell lines. Furthermore, due to the XTEN polymer providing some interference in surface binding, the untreated anti-EpCAM×anti-CD3 ProTIA is expected to bind at a lower affinity than the protease-treated ProTIA for both the CD3 and EpCAM antigens.

Example 6: Cytotoxicity Assays of Anti-EpCAM×Anti-CD3 Protease Triggered Immune Activator (ProTIA) Composition Redirected cellular cytotoxicity of anti-EpCAM×anti-CD3 ProTIA compositions were assessed by using human peripheral blood mononuclear cells (PBMC) as effectors and EpCAM positive human carcinoma cells such as SW480 colon cells (or selected from HCT-116, Kato III, NCI-N87, MKN45, MDA-MB-231, MDA-MB-453, MCF-7, MT3, SK-Br-3, SK-OV-3, OVCAR3, BT-474, HPAF-II, JIMT-1, MDA-MB-436, NCI-H322, NCI-H660, NCI-H69 and PC3) as targets. PBMC were isolated from screened, healthy donors by ficoll density gradient centrifugation from either whole blood or from lymphocyte-enriched buffy coat preparations obtained from local blood banks or Bioreclamation IVT. PBMC were resuspended and cultured at appropriate cell density as discussed below in RPMI-1640/10% FCS/25 mmol/mL HEPES at 37° C. in a 5% $CO_2$ humidified incubator until use. Three different types of cytotoxicity assays are used for the determination of the cytolytic activity of non-cleavable anti-EpCAM×anti-CD3 composition (AC1484), protease-treated and untreated anti-EpCAM× anti-CD3 cleavable ProTIA compositions (AC1278 & AC1476), namely lactate dehydrogenase (LDH) release assay, caspase 3/7 assay and FACS-based analysis.

As a non-radioactive alternative to $^{51}Cr$ release cytotoxicity assay, the LDH release assay quantitatively measures the stable cytosolic enzyme LDH that is released upon cell lysis in much the same way as $^{51}Cr$ is released in radioactive assays. Released LDH in culture supernatants is measured by an enzymatic assay that converts a tetrazolium salt into a red formazan product; the amount of color formed being proportional to the number of lysed cells.

The cytotoxic performance of the protease-treated and untreated anti-EpCAM×anti-CD3 ProTIA compositions in SW480 were thus analyzed as follows: cell density of SW480 and PBMC was first adjusted to $2.5 \times 10^5$ cells/mL and $1 \times 10^6$ cells/mL respectively in assay medium comprised of phenol red-free RPMI and 5% FCS. (Phenol red-free medium and 5% FCS were used to minimize background absorbance with the use of Promega CytoTox 96 Non-radioactive Cytotoxicity Assay kit (cat #G1780)). To achieve an effector to target ratio of 5:1, 100 microL aliquots of PBMC were co-cultured with 80 microL aliquots of SW480 cells per assay well in a 96-well round-bottom plate. Protease-treated and untreated anti-EpCAM×anti-CD3 composition samples were diluted in assay medium to the desired dose concentration and added in 20 microL to the respective experimental wells bringing the total assay volume to 200 microL. The protease-cleaved ProTIA was evaluated as a 12-point, 5× serial diluted dose concentration starting at 440 nM to obtain a final dose range of 0.000005 to 44 nM. The untreated non-cleaved ProTIA composition was analyzed as a 12 point, 5× serial diluted dose concentration starting at 184 nM to derive at a final dose range of 0.000002 to 18.4 nM. Assay controls that included spontaneous LDH released by effector and target cells; target cell maximum LDH released; volume correction control due to the addition of lysis solution and culture medium background were also set up at this time. For target spontaneous LDH released, SW480 cells were incubated in 200 microL of assay medium in the absence of any protease-treated or untreated composition. For effector spontaneous LDH released, PBMC were incubated in 200 microL of assay medium in the absence of any protease-treated or untreated composition. Target cell maximum LDH released was determined by the addition of 20 microL of 10× lysis solution to SW480 (220 microL total volume) and incubating the target cells in the presence of lysis solution for 45 min prior to harvesting the supernatant for LDH measurement. Volume correction control was achieved by adding 20 microL of 10× lysis solution to 200 microL of assay media, while culture medium background was obtained by incubating 200 microL of assay medium. The plate containing experimental wells of protease-treated and untreated anti-EpCAM×anti-CD3 ProTIA compositions and all the respective assay controls, all tested in duplicates, was then allowed to incubate overnight in a 37° C., 5% $CO_2$ humidified incubator.

The amount of LDH released into the supernatant as a result of cell lysis was measured using the Promega CytoTox Assay kit and following manufacturer's instructions. Briefly, 50 microL of the supernatant from each well of the assay plate was transferred to the corresponding well of a flat-bottomed enzymatic plate. To each well in the enzymatic plate, 50 microL of the reconstituted substrate was added. The plate was then covered, protected from light and allowed to incubate at room temperature for 30 min. After the desired incubation period, 50 microL of stop solution was added to each well and absorbance recorded at 490 nm.

Data analysis was then performed as followed:
1. Experimental, E:T ratio of 5:1 (average)–culture medium background (average)
   SW480 target spontaneous (average)–culture medium background (average)
   PBMC effector spontaneous (average)–culture medium background (average)
2. SW480 target maximum (average)–volume correction control (average)
3. % specific lysis=[(Experimental–SW480 target spontaneous–PBMC effector spontaneous)/(SW480 target maximum–SW480 target spontaneous)]×100
4. Dose concentration of protease-treated and untreated anti-EpCAM×anti-CD3 ProTIA was then plotted against % specific lysis; and the concentration of protein that gave half maximal response ($EC_{50}$) was derived with a 4-parameter logistic regression equation using GraphPad prism software.

Figure 25:
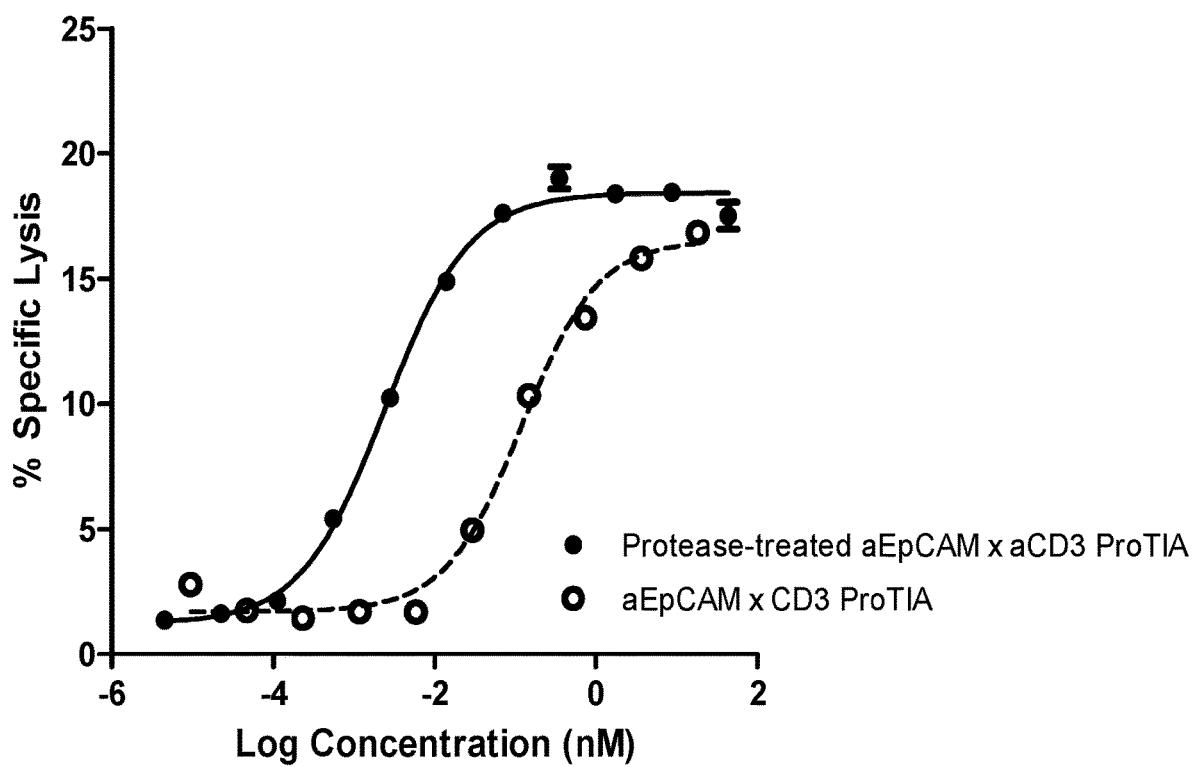
FIG. 25 depicts results from the experiment to determine the in vitro activity of protease-treated and untreated anti-EpCAM×anti-CD3 ProTIA, as described in Example 6.

As shown in FIG. 25, exposure of SW480 cells to protease-treated ProTIA and the untreated anti-EpCAM× anti-CD3 ProTIA compositions in the presence of PBMC yielded concentration-dependent cytotoxic dose curves; with the protease-treated ProTIA being 48-fold more active than the intact, untreated ProTIA ($EC_{50}$ of 2.5 pM vs. 120 pM respectively).

The specificity of the anti-EpCAM×anti-CD3 ProTIA was further evaluated by comparing the cytotoxic activity of protease-treated and protease-untreated ProTIA to that of unconjugated monospecific anti-EpCAM scFv and monospecific anti-CD3 scFv in the LDH assay. Briefly, PBMC and SW480 cells were co-cultured in an effector to target ratio of 5:1 in assay medium in a 96-well round-bottom plate as described above. Protease-treated anti-EpCAM×anti-CD3 ProTIA, protease-untreated anti-EpCAM×anti-CD3 ProTIA, and unconjugated monospecific anti-EpCAM scFv plus monospecific anti-CD3 scFv samples were all evaluated as a 12-point, 5× serial dilution of a final dose range of 0.00005 to 45 nM in a total assay volume to 200 microL. Together with experimental wells, all relevant assay controls as described above were also included in the assay plate and the plate was incubated overnight in a 37° C., 5% $CO_2$ humidified incubator.

The amount of LDH released into the supernatant as a result of cell lysis was measured using the Promega CytoTox Assay kit and results analyzed as described above.

Figure 26:
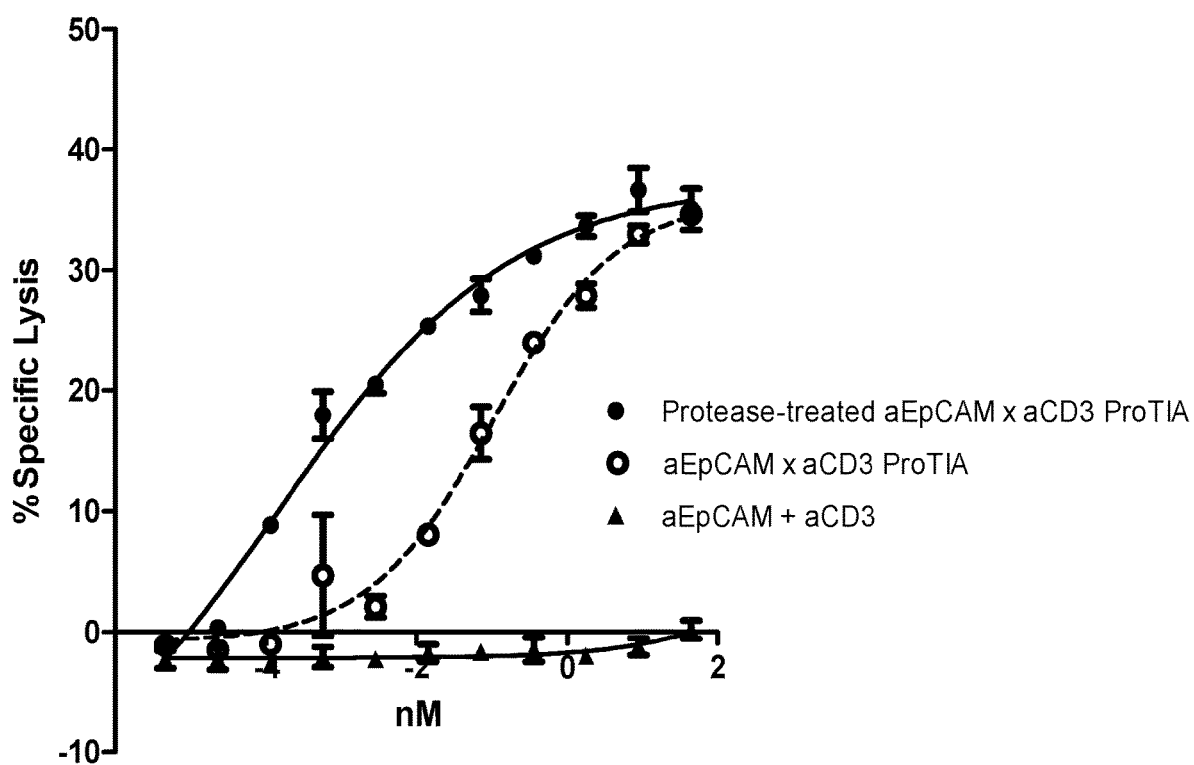
FIG. 26 depicts results from the experiment to determine the in vitro specificity of anti-EpCAM×anti-CD3 ProTIA, as described in Example 6.

As expected, exposure of SW480 cells to protease-treated anti-EpCAM×anti-CD3 ProTIA in the presence of PBMC show enhanced cytotoxicity as compared to untreated ProTIA. Significantly, combining monospecific anti-EpCAM scFv and monospecific anti-CD3 scFv in the presence of SW480 target cells and PBMC did not result in any cytotoxic activity (FIG. 26). The data indicate that linking the targeting aEpCAM moiety to the a CD3 effector moiety in the form of a bispecific molecule is required for the active recruitment of CD3 positive cells to the vicinity of the target cells for induced cytotoxicity.

We also hypothesized that the release segment cleavage sequence present in the anti-EpCAM×anti-CD3 ProTIA may by itself be susceptible to cleavage by proteases released by the tumor cells or by activated CD3 positive T cells (e.g. granzymes). To address this hypothesis, a non-cleavable anti-EpCAM×anti-CD3 ProTIA without the release segment (AC1357) was constructed and evaluated in conjugation with the protease-treated and untreated anti-EpCAM×anti-CD3 ProTIA (AC1278). All three ProTIA were analyzed in the LDH assay using a 5:1 PBMC to SW480 ratio and tested in a 12-point dose concentration range of 0.00005 to 45 nM achieved with a 5× serial dilution scheme.

Figure 27:
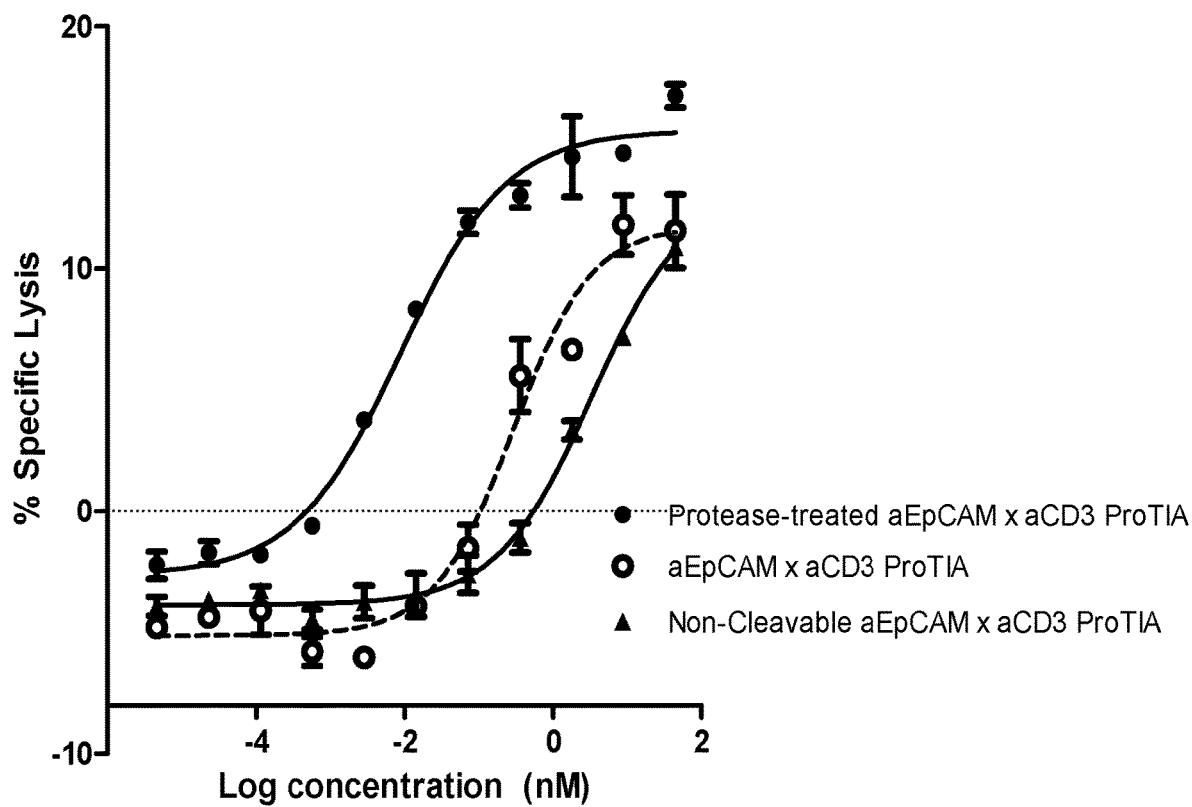
FIG. 27 depicts results from the experiment to determine the in vitro activity of protease-treated, protease-untreated and protease-uncleavable anti-EpCAM×anti-CD3 ProTIA, as described in Example 6.

As shown in FIG. 27, untreated anti-EpCAM×anti-CD3 ProTIA is 32-fold less active than protease-treated ProTIA ($EC_{50}$ of 288 pM vs. 8.9 pM). Interestingly, the non-cleavable anti-EpCAM×anti-CD3 ProTIA (i.e., ProTIA without the release segment cleavage sequence) is 371-fold less active than the protease-cleaved ProTIA ($EC_{50}$ of 3300 pM vs. 8.9 pM). The results suggest that the release segment contained within the cleavable anti-EpCAM×anti-CD3 ProTIA molecule is susceptible to some cleavage by proteases likely released from the tumor cells and/or activated CD3 positive T cells.

Figure 30:
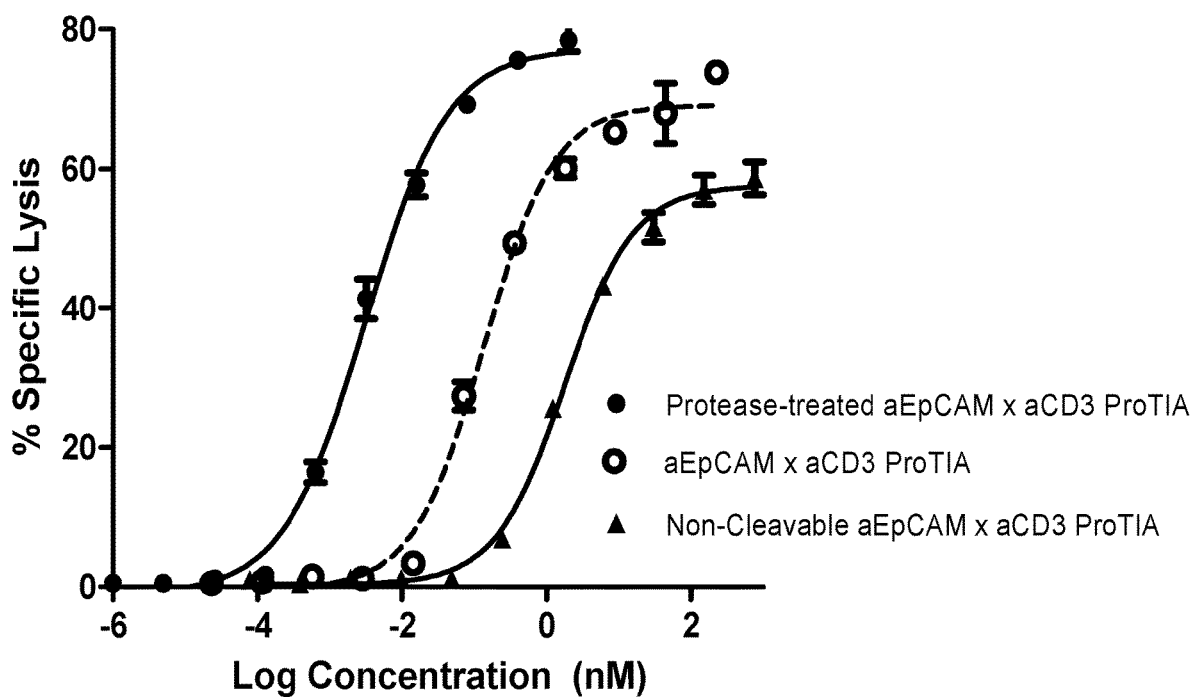
FIG. 30 depicts results from the experiment to determine the in vitro activity of protease-treated, protease-untreated and protease-noncleavable anti-EpCAM×anti-CD3 ProTIA in SK-OV-3 as described in Example 6.

The non-cleavable anti-EpCAM×anti-CD3 ProTIA without the release segment (AC1484) and protease-treated and untreated anti-EpCAM×anti-CD3 ProTIA (AC1476) were also evaluated in human cell line of ovarian origin. In this experiment, PBMC was mixed with SK-OV-3 ovarian cells in a ratio of 5:1 and all three ProTIA molecules were tested as a 12-point, 5× serial dilution dose curve in the LDH assay as described above. As expected, the activity trend of the three ProTIA molecules profiled in SK-OV-3 ovarian cell line was found to be similar to that observed in the SW480 colorectal cell line. In SK-OV-3 cells, untreated anti-Ep-CAM×anti-CD3 ProTIA was 45-fold less active than protease-treated ProTIA ($EC_{50}$ of 136 pM vs. 3 pM); and the non-cleavable anti-EpCAM×anti-CD3 ProTIA was 600-fold less active than the protease-cleaved ProTIA ($EC_{50}$ of 1793 pM vs. 3 pM) (FIG. 30).

Example 7: Cell Lysis Assessed by Flow Cytometry

For analysis of cell lysis after 24 h by flow cytometer, EpCAM positive SK-OV-3 target cells (or target cells selected from HCT-116, Kato III, MDA-MB-453, MCF-7, MKN45, MT3, NCI-N87, SK-Br-3, SW480, OVCAR3, BT-474, HPAF-II, JIMT-1, MDA-MB-436, NCI-H322, NCI-H660, NCI-H69 and PC3 cell lines) are labeled with the fluorescent membrane dye CellVue Maroon dye (Affymetrix/eBioscience, cat #88-0870-16) according to manufacturer's instructions. Alternatively PKH26 (Sigma, cat #MINI26 and PKH26GL) can also be used. In brief, SK-OV-3 cells are washed twice with PBS followed by resuspension of $2\times10^6$ cells in 0.1 mL diluent C provided with the CellVue Maroon labeling kit. In a separate tube, 2 mircoL of CellVue Maroon dye is mixed with 0.5 mL diluent C, and then 0.1 mL added to the SK-OV-3 cell suspension. The cell suspension and CellVue Maroon dye are mixed and incubated for 2 min at room temperature. The labeling reaction is then quenched by the addition of 0.2 mL of FCS. Labeled cells are washed twice with complete cell culture medium (RPMI-1640 containing 10% FCS) and total number of viable cells determined by trypan blue exclusion. For an effector to target ratio of 5:1 in a total volume of 200 microL per well, $1\times10^5$ PBMC are co-cultured with $2\times10^4$ CellVue Maroon-labeled SK-OV-3 cells per well in a 96-well round-bottom plate in the absence or presence of the indicated dose range concentration of protease-treated and untreated anti-EpCAM×anti-CD3 ProTIA samples. After 24 h, cells are harvested with Accutase (Innovative Cell Technologies, cat #AT104) and washed with 2% FCS/PBS. Before cell acquisition on a Guava easyCyte flow cytometer (Millipore), cells are resuspended in 100 microL 2% FCS/PBS supplemented with 2.5 micrograms/mL 7-AAD (Affymetrix/eBioscience, cat #00-6993-50) to discriminate between alive (7-AAD-negative) and dead (7-AAD-positive) cells. FACS data are analyzed with guavaSoft software (Millipore); and percentage of dead target cells is calculated by the number of 7-AAD-positive/CellVue Maroon-positive cells divided by the total number of CellVue Maroon-positive cells.

Dose response kill curves of percent cytotoxicity against ProTIA concentration are analyzed by 4 parameter-logistic regression equation using GraphPad Prism; and the concentration of ProTIA that induced half maximal percent cell cytotoxicity is thus determined.

Cytotoxicity results utilizing flow cytometry are expected to be in line with results obtained with the LDH assay. Exposure of SK-OV-3 cells to protease-cleaved and uncleaved anti-EpCAM×anti-CD3 ProTIA compositions in the absence of PBMC are expected to have no effect. Similarly, PBMC are not expected to be activated in the presence of ProTIA without target cells. These results are expected to indicate that ProTIA compositions need to be clustered on the surface of target cells in order to stimulate PBMC for cytotoxicity activity. In the presence of PBMC and target cells, there would be a concentration-dependent cytotoxic effect due to ProTIA pretreated or untreated with protease. Further, results are expected to show that exposure of SK-OV-3 cells to untreated ProTIA (no protease) in the presence of PBMC would show reduced cytotoxicity as compared to protease-cleaved ProTIA composition.

The above set of cytotoxicity experiments is performed for other bispecific ProTIA compositions such as anti-CD19×anti-CD3 ProTIA composition and anti-HER2×anti-CD3 ProTIA composition. In these instances, CD19 and HER2 positive target cells will be used instead of EpCAM positive cells. Example cell lines for CD19 expressing cells will include but not limited to NAML-6, Blin-1, SKW6.4, Raji, Daudi and BJAB. For anti-HER2 targeting, HER2 positive cell lines such as SK-BR-3, BT474, HCC-1954, MDA-MB-453, SK-OV-3, NCI-N87, JIMT-1, HCT-116 will be used.

Example 8: T-Cell Activation Marker Assays of Anti-EpCAM×Anti-CD3 Protease Triggered Immune Activator (ProTIA) Composition To measure the anti-EpCAM×anti-CD3 ProTIA induced activation markers (CD69 and CD25), $1×10^5$ PBMC or purified CD3+ cells were co-cultured in RPMI-1640 containing 10% FCS with $2×10^4$ SK-OV-3 or OVCAR3 cells per assay well (i.e., effector to target ratio of 5:1) in the presence of anti-EpCAM×anti-CD3 ProTIA (AC1476) in a 96-well round-bottom plate with total final volume of 200 microL. After 20 h incubation in a 37° C., 5% $CO_2$ humidified incubator, cells were stained with PECy5-conjugated anti-CD4, APC-conjugated anti-CD8, PE-conjugated anti-CD25, and FITC-conjugated anti-CD69 (all antibodies from BioLegend) in FACS buffer (1% BSA/PBS) at 4° C., washed twice with FACS buffer, and then re-suspended in FACS buffer for acquisition on a Guava easyCyte flow cytometer (Millipore).

As expected, the T-cell activation marker expression trend of the three ProTIA molecules profiled in SK-OV-3 ovarian cell line was found to be similar to that observed by LDH cytotoxicity assay. Using SK-OV-3 cells, activation of CD69 on CD8 and CD4 populations of PBMC by untreated anti-EpCAM×anti-CD3 ProTIA (AC1476) was ~70-fold less active than protease-treated AC1476 ProTIA ($EC_{50}$ of 540 pM vs. 6.7 pM for CD8+, $EC_{50}$ of 430 pM vs. 6.3 pM for CD4+); and the non-cleavable anti-EpCAM×anti-CD3 ProTIA (AC1484) was ~1000-fold less active than the protease-cleaved ProTIA ($EC_{50}$ of 8700 pM vs. 6.7 pM for CD8+, $EC_{50}$ of 6000 pM vs. 6.3 pM for CD4+) (FIG. 42).

Similarly, activation of both CD69 and CD25 on CD8 and CD4 populations of PBMC cells by untreated anti-EpCAM×anti-CD3 ProTIA (AC1476) was ~60-fold less active than protease-treated ProTIA (MMP-9 treated AC1476), and the non-cleavable anti-EpCAM×anti-CD3 ProTIA (AC1484) was ~1300-fold less active than the protease-cleaved ProTIA (FIG. 43).

To confirm the mechanism of action is through CD3+ cells, SK-OV-3 cells were used as target cells, and activation of CD69 on CD8 and CD4 populations of purified CD3+ cells by untreated anti-EpCAM×anti-CD3 ProTIA (AC1476) was ~100-fold less active than protease-treated ProTIA ($EC_{50}$ of 260 pM vs. 2.4 pM for CD8+, $EC_{50}$ of 240 pM vs. 2.2 pM for CD4+); and the non-cleavable anti-EpCAM×anti-CD3 ProTIA (AC1484) was ~2000-fold less active than the protease-cleaved ProTIA ($EC_{50}$ of 5000 pM vs. 2.4 pM for CD8+, $EC_{50}$ of 5000 pM vs. 2.2 pM for CD4+) (FIG. 44). Activation of both CD69 and CD25 on CD8 and CD4 populations of purified CD3+ cells by untreated anti-EpCAM×anti-CD3 ProTIA (AC1476) was ~100-fold less active than protease-treated ProTIA (MMP-9 treated AC1476), and the non-cleavable anti-EpCAM×anti-CD3 ProTIA (AC1484) was ~2000-fold less active than the protease-cleaved ProTIA (FIG. 45).

Using OVCAR3 cells, activation of CD69 on CD8 and CD4 populations of purified CD3+ cells by untreated anti-EpCAM×anti-CD3 ProTIA (AC1476) was ~10-fold less active than protease-treated ProTIA ($EC_{50}$ of 14 pM vs. 1.8 pM for CD8+, $EC_{50}$ of 16 pM vs. 1.9 pM for CD4+); and the non-cleavable anti-EpCAM×anti-CD3 ProTIA (AC1484) was ~1000-fold less active than the protease-cleaved ProTIA ($EC_{50}$ of 2000 pM vs. 1.8 pM for CD8+, $EC_{50}$ of 1500 pM vs. 1.9 pM for CD4+) (FIG. 46). Activation of both CD69 and CD25 on CD8 and CD4 populations of purified CD3+ cells by untreated anti-EpCAM×anti-CD3 ProTIA (AC1476) was also ~10-fold less active than protease-treated ProTIA (MMP-9 treated AC1476), and the non-cleavable anti-EpCAM×anti-CD3 ProTIA (AC1484) was also ~1000-fold less active than the protease-cleaved ProTIA (MMP-9 treated AC1476). These results suggest the untreated anti-EpCAM×anti-CD3 ProTIA was cleaved during the assay to a greater extent in the presence of OVCAR3 cells compared to SK-OV-3 cells (FIG. 47).

As further evidence of activation of T cells by anti-EpCAM×anti-CD3 ProTIA in the presence of target cells, induction of CD69 and granzyme B were measured. PBMC ($1×10^5$) were co-cultured with $2×10^4$ OVCAR3 cells per assay well (i.e., effector to target ratio of 5:1) in the presence of anti-EpCAM×anti-CD3 ProTIA in a 96-well round-bottom plate with total final volume of 200 microL. After 20 h incubation in a 37° C., 5% $CO_2$ humidified incubator, cells were stained with PECy5-conjugated anti-CD4, APC-conjugated anti-CD8, and FITC-conjugated anti-CD69 (all antibodies from BioLegend) in FACS buffer (1% BSA/PBS) at 4° C. Cells were then fixed and permeabilized with 0.1% Triton X-100/PBS before staining with PE-conjugated anti-granzyme B (ThermoFisher, cat #MHGB04) in FACS buffer. Cells were washed with FACS buffer and then resuspended in FACS buffer for acquisition on a Guava easyCyte flow cytometer.

As expected, both CD69 and granzyme B are expressed in ProTIA-activated T cells in the presence of OVCAR3 cells. Additionally, a greater fraction of CD8+ cells express granzyme B compared to CD4+ cells (FIGS. 48 and 49).

Example 9: Pharmacokinetic Properties of Anti-EpCAM×Anti-CD3 Protease Triggered Immune Activator (ProTIA) Composition The pharmacokinetic properties of anti-EpCAM×anti-CD3 ProTIA were analyzed in C57BL/6 mice. Three mice in group 1 were injected intravenously with 4 mg/kg of protease-treated anti-EpCAM×anti-CD3 ProTIA (AC1278), and 3 mice in group 2 were injected intravenously with untreated anti-EpCAM×anti-CD3 ProTIA (AC1278). At appropriate time points, blood was collected into lithium heparinized tubes and processed into plasma. For the protease-treated anti-EpCAM×anti-CD3 ProTIA animals, plasma collection time points were pre-dose, 2 min, 15 min, 30 min, 2 h, 4 h, 8 h and 24 h. For the untreated ProTIA mice, plasma collection time points were pre-dose, 4 h, 8 h, 24 h, 2 d, 4 d, 6 d and 7 d. Plasma concentration of protease-treated ProTIA was quantified by a rhEpCAM/ biotinylated-anti-His tag sandwich ELISA with the protease-cleaved ProTIA as standard; while plasma concentration of untreated ProTIA was quantified by a rhEpCAM/biotinylated-anti-XTEN sandwich ELISA with the uncleaved ProTIA as standard.

Briefly, ELISA plate (Nunc Maxisorp cat #442404) was coated with 0.1 mircog/100 microL per well of rhEpCAM (R&D Systems, cat #EHH104111). After overnight incubation at 4° C., the ELISA plate was washed and blocked with 3% BSA for 1 h at room temperature. The plate was washed again followed by the appropriate addition of a dose range of protease-treated and untreated anti-EpCAMxanti-CD3 ProTIA standards, appropriate quality controls and plasma test samples. The plate was allowed to incubate with shaking for 1 h at room temperature to allow the ProTIA standards, quality controls and test samples to bind to rhEpCAM coated on the plate. Unbound components were removed with several washes. For the detection of protease-cleaved ProTIA, biotinylated anti-His tag antibody (R&D Systems, cat #BAM050) was added at 0.2 microg/100 microL and plate allowed to incubate at room temperature for 1 h. For the detection of the protease-untreated ProTIA, biotinylated anti-XTEN antibody (a proprietary antibody) was added at 0.1 microg/100 microL and the plate allowed to incubate at room temperature for 1 h. After washing away unbound biotinylated reagent, streptavidin-HRP (Thermo Scientific cat #21130) was added at 1:30,000 dilution and plate incubated at room temperature for 1 h. After several washes, TMB substrate was added to each well. Once desired color intensity was reached, 0.2 N sulfuric acid was added to stop the reaction and absorbance (OD) was measured at 450 nm using a spectrophotometer. The intensity of the color is proportional to the concentration of protease-treated and untreated ProTIA captured by the respective rhEpCAM/biotinylated-anti-His tag and rhEpCAM/biotinylated-anti-XTEN sandwich ELISA. The concentration of ProTIA present in the plasma samples was determined against the appropriate protease-treated or untreated ProTIA standard curve using SoftMax Pro software. Pharmacokinetic calculations of terminal half-life ($T_{1/2}$) of the protease-cleaved and uncleaved anti-EpCAMxanti-CD3 ProTIA were performed with GraphPad Prism.

Figure 28:
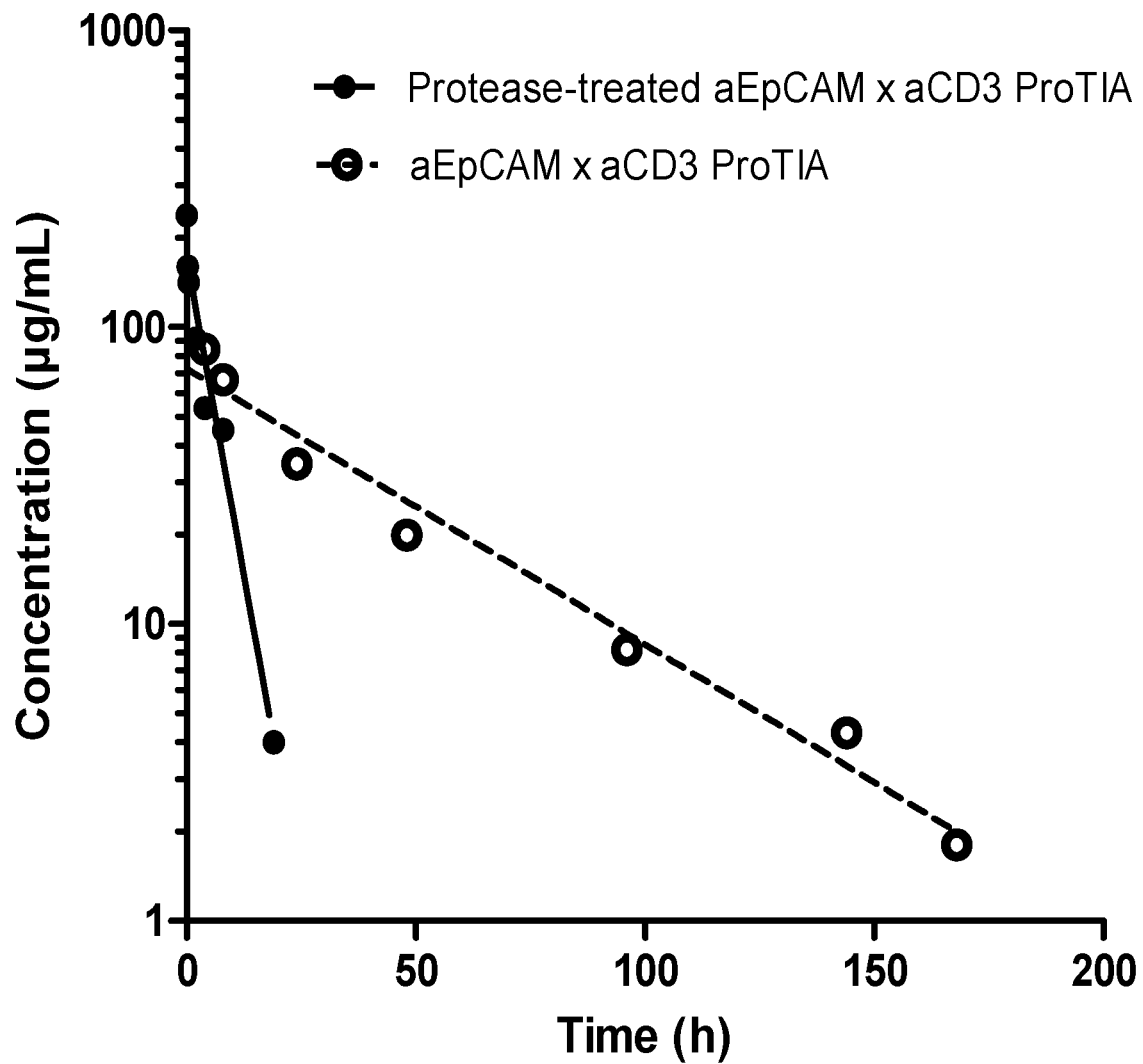
FIG. 28 depicts results from the experiment to determine the PK of protease-treated and untreated anti-EpCAM×anti-CD3 ProTIA, as described in Example 9.

In line with expectation, the protease-treated anti-EpCAMxanti-CD3 ProTIA has a short terminal elimination half-life ($T_{1/2}$) of about 3.5 h, whereas the protease-untreated ProTIA (with attached XTEN) has an extended $T_{1/2}$ of 32 h (FIG. 28), confirming that the intact ProTIA molecule has significantly longer half-life (at least 9-fold longer) than the cleaved molecule.

Example 10: Anti-Tumor Properties of Anti-EpCAMxAnti-CD3 Protease Triggered Immune Activator (ProTIA) Composition in Early Treatment SW480 Model An in vivo efficacy experiment was performed in immunodeficient NOD/SCID mice, characterized by the deficiency of T and B cells, and impaired natural killer cells. Mice were maintained in sterile, standardized environmental conditions and experiment performed in accordance to US Institutional Animal Care Association for Assessment and Use Committee (IACUC Accreditation of Laboratory Animal Care (AAALAC) guidelines. The efficacy of protease-treated and protease-untreated anti-EpCAMxanti-CD3 ProTIA (AC1278) was evaluated using the human SW480 carcinoma xenograft model. Briefly, on day 0, six cohorts of 5 NOD/SCID mice per group were subcutaneously injected in the right flank with $1\times10^7$ human PBMC mixed with $1\times10^7$ SW480 cells. An hour after SW480/PBMC inoculation, cohort 1 was injected with vehicle (PBS+0.05% Tween 80), cohort 2 and 3 with 0.04 mg/kg and 0.4 mg/kg protease-treated anti-EpCAMxanti-CD3 ProTIA respectively, cohort 4 and 5 with 0.1 mg/kg and 1 mg/kg protease-untreated anti-EpCAMxanti-CD3 ProTIA and cohort 6 with 1 mg/kg protease-untreated anti-EpCAMxanti-CD3 ProTIA. Cohort 1 to 5, but not cohort 6, were further subjected to four additional doses administered daily from day 1 to day 4.

Tumors were measured twice per week for a projected 35 days with a caliper in two perpendicular dimensions and tumor volumes were calculated by applying the (width$^2$× length)/2 formula. Body weight, general appearance and clinical observations such as seizures, tremors, lethargy, hyper-reactivity, pilo-erection, labored/rapid breathing, coloration and ulceration of tumor and death were also closely monitored as a measure of treatment related toxicity. Study endpoint was defined as a tumor volume of 2000 mm$^3$ or survival to 36 days, whichever comes first. Percent tumor growth inhibition index (% TGI) was calculated for each of the treatment group by applying the formula: ((Mean tumor volume of PBSvehicle control −Mean tumor volume of ProTIA treatment)/mean tumor volume of PBSvehicle control)×100. Treatment group with % TGI≥60% is considered therapeutically active.

Figure 31:
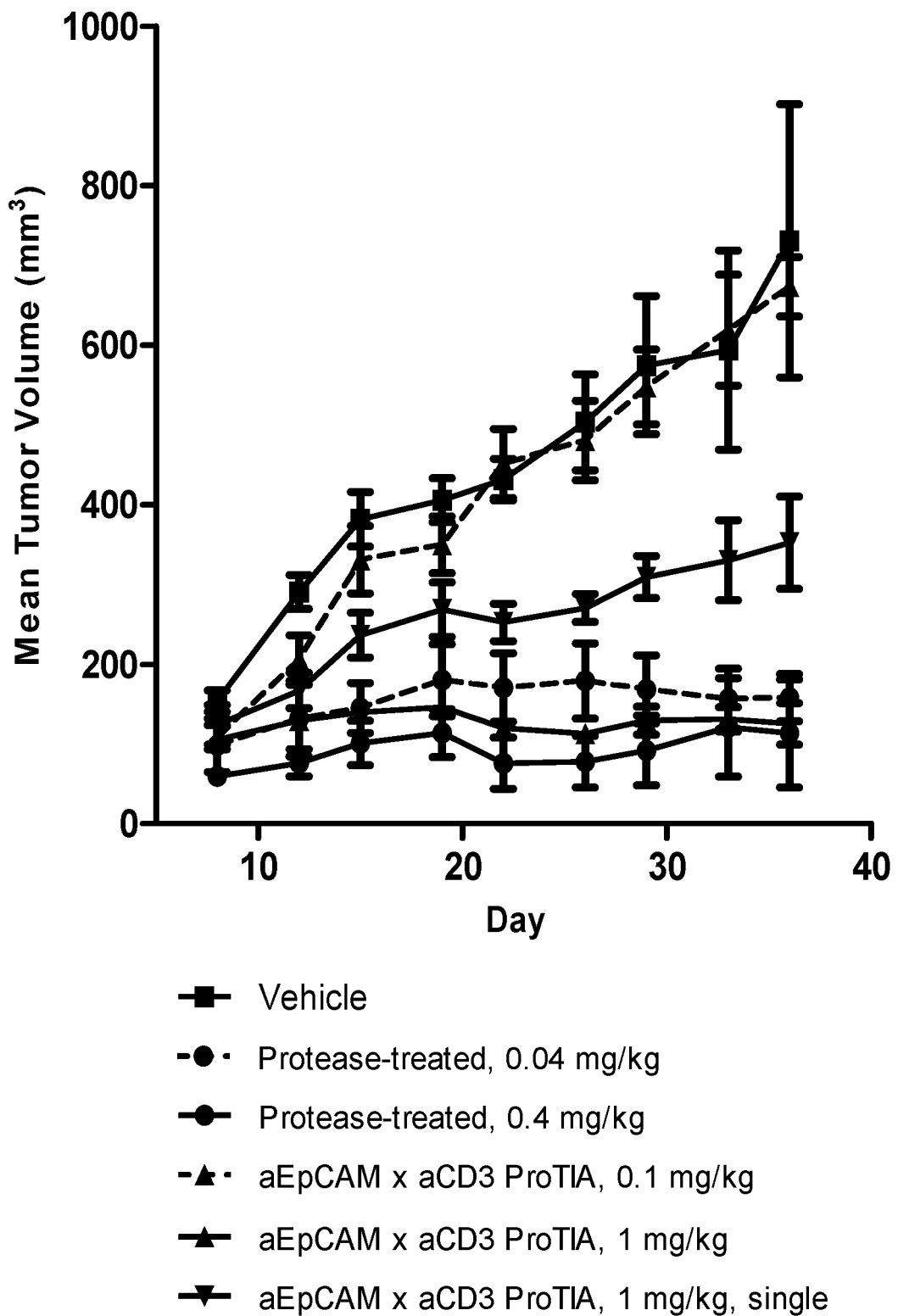
FIG. 31 depicts tumor volume results from experiment to determine the anti-tumor effect of protease-treated and untreated anti-EpCAM×anti-CD3 ProTIA, as described in Example 10.

At day 36, cohort 1 mice treated with PBS vehicle in the presence of human effector cells did not inhibit tumor progression, demonstrating that human effector cells alone as such could not elicit an anti-tumor effect. Treatment with the protease-treated anti-EpCAMxanti-CD3 ProTIA at 0.04 mg/kg and 0.4 mg/kg (cohort 2 and 3 respectively) in the presence of human effector cells exhibited clear dose-dependent response for suppression of tumor growth with the 0.4 mg/kg dose group providing more protection (% TGI=84%) than the 0.04 mg/kg dose group (% TGI=78%). Significantly, treatment with anti-EpCAMxanti-CD3 ProTIA at 1 mg/kg (cohort 5) in the presence of human effector cells also inhibited tumor growth (% TGI=83%) to almost the same extend as molar-equivalent 0.4 mg/kg protease-treated ProTIA (cohort 3). Data suggest that at 1 mg/kg, sufficient anti-EpCAMxanti-CD3 ProTIA was effectively cleaved by proteases in the in vivo tumor environment to the more active, unXTENylated anti-EpCAMxanti-CD3 moiety to yield the observed efficacy. The lack of tumor regression in the 0.1 mg/kg protease-untreated anti-EpCAMxanti-CD3 ProTIA cohort 4 (% TGI=8%) suggested that at this dose, insufficient unXTENylated anti-EpCAMxanti-CD3 moiety was released to induced noticeable tumor regression. Cohort 6, subjected to a single 1 mg/kg dose of anti-EpCAMxanti-CD3 ProTIA, did not attained the threshold for therapeutic activity (% TGI=52%) despite exhibiting suppressed tumor growth as compared to control group (FIG. 31). Results suggest that anti-EpCAMxanti-CD3 ProTIA can be effectively cleaved in the SW480 tumor environment to inhibit tumor progression and drug concentration plus exposure are important factors in determining drug efficacy.

Figure 32:
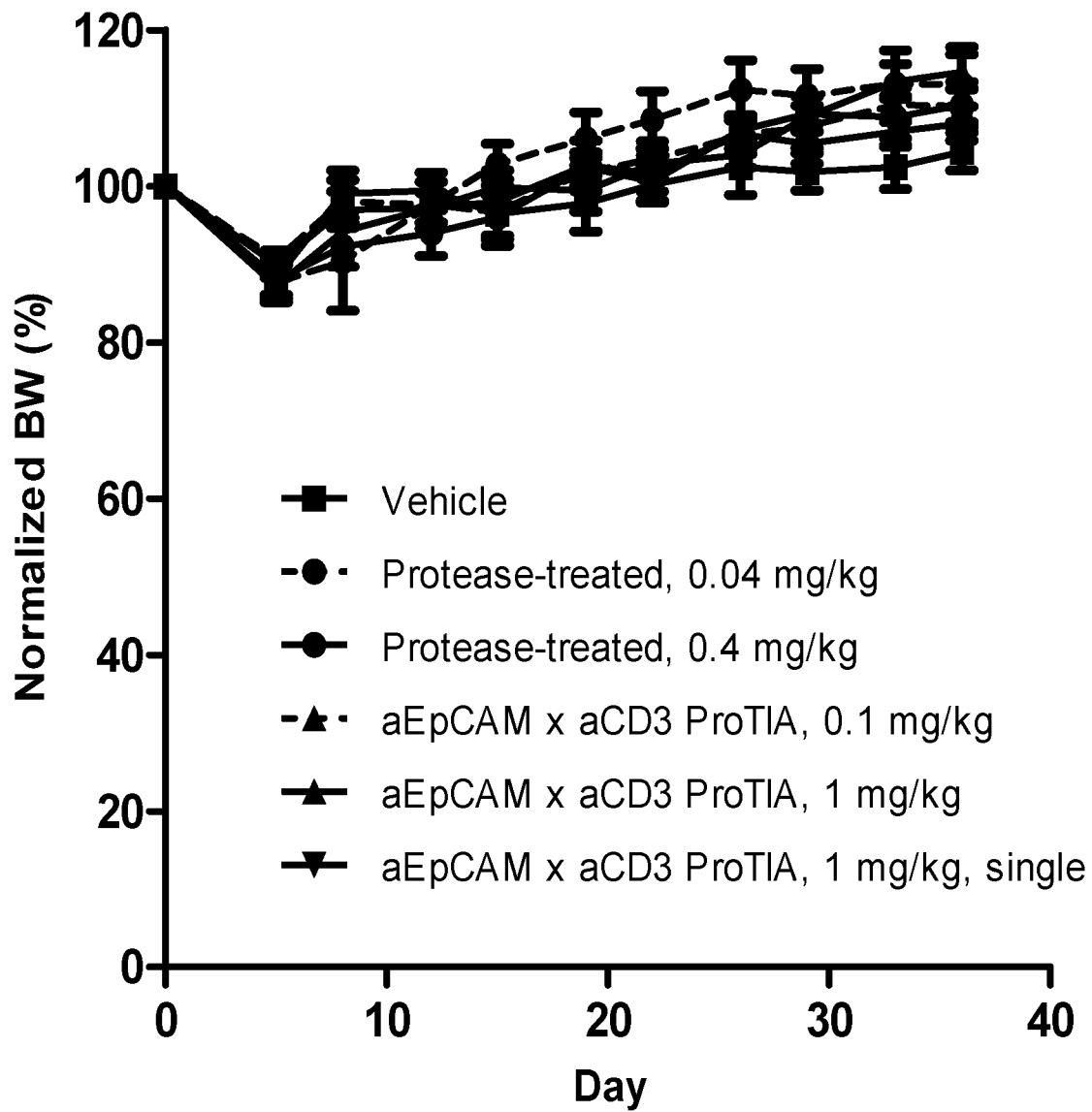
FIG. 32 depicts body weight results from an experiment to determine the anti-tumor effect of protease-treated and untreated anti-EpCAM×anti-CD3 ProTIA, as described in Example 10.
Figure 36:
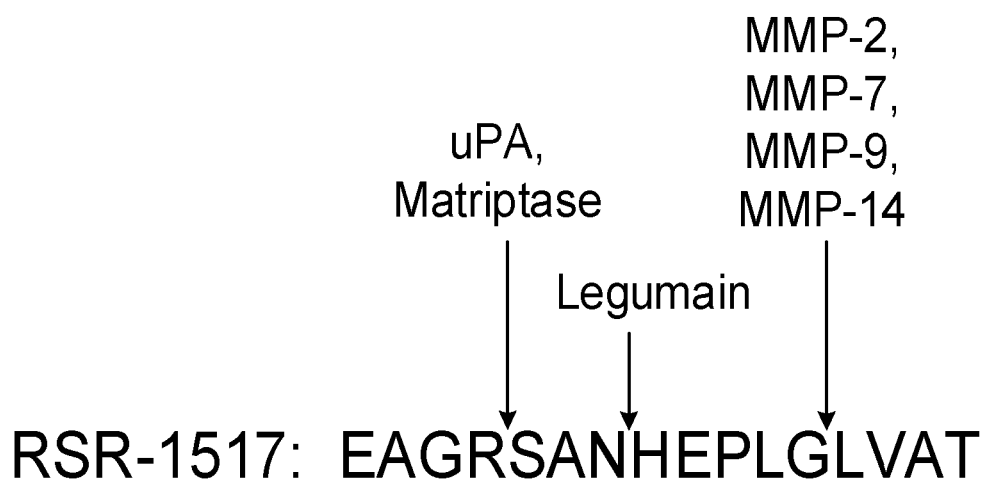
FIG. 36 depicts the amino acid sequence of the release segment RSR-1517 and the location of the three cleavage sites where the listed proteases are able to cleave the peptide.

Of note, no significant body weight loss was observed in all ProTIA treatment groups and vehicle control indicating that all treatments were well tolerated (FIG. 32).

The specificity of the antitumor activity of protease-untreated anti-EpCAMxanti-CD3 ProTIA variants is performed in SW480/PBMC inoculated NOD/SCID mice much like the study described above but with eight mice per treatment group. In this study, early treatment with PBS vehicle control, non-cleavable anti-EpCAMxanti-CD3 ProTIA (AC1357 or AC1484), a bispecific negative control ProTIA (having the binding activity for CD3 but not for EpCAM), protease-untreated anti-EpCAM×anti-CD3 ProTIA (e.g. AC1278, AC1476, AC1684, AC1685, AC1686, AC1693, AC1695, AC1714, AC1715) or protease-treated anti-EpCAM×anti-CD3 ProTIA is initiated an hour after SW480/PBMC inoculation. The 1 mg/kg dose concentration of protease-untreated anti-EpCAM×anti-CD3 ProTIA as determined in the above study is used in this study and the bispecific negative control ProTIA, non-cleavable and protease-treated anti-EpCAM×anti-CD3 ProTIA test articles are all intravenously administered at equimolar concentration. Tumor volume, body weight and clinical observations are monitored two times per week for 35 days.

Treatment with PBS vehicle and the bispecific control ProTIA in the presence of human effector cells are not expected to induce anti-tumor effects, demonstrating that neither human effector cells alone nor a non-EpCAM targeting moiety could elicit an anti-tumor effect. Mice in both these treatment groups are expected to meet the study endpoint (day 35 or tumor volume of 2000 mm$^3$). Five daily doses of protease-treated and untreated anti-EpCAM×anti-CD3 ProTIA, in the presence of human effector are expected to induce suppression of tumor growth. Treatment with equimolar concentration of the non-cleavable ProTIA is expected to minimally retard tumor growth as it does not contain the substrate for protease cleavage.

Example 11: Anti-Tumor Properties of Anti-EpCAM×Anti-CD3 Protease Triggered Immune Activator (ProTIA) Composition in Established Colorectal Tumor Model In the established colorectal tumor model, SW480 or HCT-116 tumor cells are independently implanted into NOG (NOD/Shi-scid/IL-2Rg$^{null}$) or NSG (NOD.Cg-Prkdc$^{scid}$.IL2rg$^{tm1Wjl}$/SzJ) mice on day 0. (The NOG or NSG mice are NOD/SCID mice bearing IL-2Rg mutation resulting in the mice lacking T, B and NK cells, dysfunctional macrophage, dysfunctional dendritic cells and reduced complement activity.) Human PBMC are then intravenously or intraperitoneally introduced sometime between days 3 to 10. When the SW480 and HCT-116 tumor have reached a volume of 150 mm$^3$, treatment with protease-treated anti-EpCAM×anti-CD3 ProTIA, intact protease-untreated anti-EpCAM×anti-CD3 ProTIA and a non-cleavable form of anti-EpCAM×anti-CD3 ProTIA is initiated as three doses per week for three to four weeks. It is expected that both protease-cleaved and protease-untreated ProTIA (e.g. AC1684, AC1685, AC1686, AC1693, AC1695, AC1714, and AC1715) will lead to reduction or eradication of established SW480 and HCT-116 tumors, with the protease-untreated ProTIA having the potential to impart better therapeutic exposure over time resulting in a more efficacious anti-tumor effect and better safety profile than protease-treated ProTIA. It is also postulated that differences in Release Segments are likely to play a role in efficacy profile among the protease-untreated ProTIAs.

The non-cleavable anti-EpCAM×anti-CD3 ProTIA (e.g. AC1484) is expected to minimally retard tumor growth as it does not contain the substrate sequence for protease cleavage within the tumor environment.

Example 12: Cytometric Bead Array Analysis for Human Th1/Th2 Cytokines Using Stimulated Normal Healthy Human PBMCs and Intact and Protease-Treated Anti-EpCAM×Anti-CD3 ProTIA As a safety assessment of the ability of intact versus cleaved anti-EpCAM×anti-CD3 ProTIA to stimulate release of T-cell related cytokines in a cell-based in vitro assay, a panel of cytokines including IL-2, IL-4, IL-6, IL-10, TNF-alpha, IFN-gamma were analyzed using the cytometric bead array (CBA) on supernatants from cultured human PBMC stimulated with protease-treated and untreated anti-EpCAM×anti-CD3 ProTIA samples. The anti-human CD3 antibody, OKT3, was used as positive control and untreated wells served as negative control.

Briefly, OKT3 (0, 10 nM, 100 nM and 1000 nM) and protease-treated and untreated anti-EpCAM×anti-CD3 ProTIA (AC1278 at 10 nM, 100 nM, 1000 nM and 2000 nM) were dry coated onto a 96-well flat bottomed plate by allowing the wells to evaporate overnight in the biosafety hood. Wells were then washed once gently with PBS and 1×10$^6$ PBMC in 200 microL were added to each well. The plate was then incubated at 37° C., 5% $CO_2$ for 24 h, after which tissue culture supernatant was collected from each well and analyzed for cytokine released using the validated commercial CBA kit (BD CBA human Th1/Th2 cytokine kit, cat #551809) by flow cytometry following manufacturer's instructions.

Results

The raw data for detected levels of cytokines are presented in Table 12, and are depicted graphically in FIGS. 33-35.

TABLE 12

Cytokine levels in response to test compound

| Cytokine | Compound (nM) | Detected Cytokine (pg/ml) | | |
|---|---|---|---|---|
| | | Untreated | OKT3 | ProTIA-X | ProTIA-A |
| IL-2 | 0 | 7.8 | | | |
| IL-4 | | 6.1 | | | |
| IL-6 | | 33.4 | | | |
| IL-10 | | 20.7 | | | |
| TNFa | | 2.1 | | | |
| IFNg | | 0.0 | | | |
| IL-2 | 10 | | 12.8 | 9.0 | 7.5 |
| IL-4 | | | 9.5 | 4.1 | 11.2 |
| IL-6 | | | 130.2 | 26.3 | 25.2 |
| IL-10 | | | 23.8 | 20.8 | 16.8 |
| TNFa | | | 6.1 | 4.8 | 2.1 |
| IFNg | | | 47.4 | 1.5 | 1.1 |
| IL-2 | 100 | | 250.6 | 9.4 | 13.1 |
| IL-4 | | | 32.7 | 7.7 | 9.2 |
| IL-6 | | | 6658.1 | 22.9 | 56.4 |
| IL-10 | | | 486.3 | 18.3 | 20.7 |
| TNFa | | | 6120.1 | 2.8 | 10.0 |
| IFNg | | | 15512.9 | 3.5 | 106.5 |
| IL-2 | 1000 | | 156.0 | 8.1 | 23.8 |
| IL-4 | | | 33.5 | 7.7 | 5.8 |
| IL-6 | | | 7962.1 | 32.7 | 3683.7 |
| IL-10 | | | 206.0 | 16.4 | 88.0 |
| TNFa | | | 10118.1 | 4.6 | 91.5 |
| IFNg | | | 14060.9 | 0.0 | 1371.5 |
| IL-2 | 2000 | | | 9.2 | 28.5 |
| IL-4 | | | | 9.8 | 9.7 |
| IL-6 | | | | 35.2 | 589.3 |
| IL-10 | | | | 16.9 | 163.9 |
| TNFa | | | | 3.1 | 250.4 |
| IFNg | | | | 0.4 | 3330.0 |

As expected, OKT3, but not untreated wells, induced robust secretion of all cytokines (IL-2, IL-4, IL-6, IL-10, TNF-alpha, IFN-gamma) evaluated, thereby confirming the performance of the CBA cytokine assay. Stimulation with protease-treated anti-EpCAM×anti-CD3 ProTIA triggered significant cytokine expression, especially at concentrations higher than 100 nM for all of the cytokines tested. In contrast, baseline levels of IL-2, IL-6, IL-10, TNF-alpha and IFN-gamma were detected when the intact non-cleaved anti-EpCAM×anti-CD3 ProTIA molecule was the stimulant at a concentration range of 10 to 2000 nM. While an appreciable level of IL-4 was detected when induced with the protease-untreated ProTIA, the level of IL-4 was, however, not higher than that observed with the protease-treated ProTIA (FIGS. 33-35). These data suggest that the XTEN polymer of the intact ProTIA composition provides considerable shielding effect and hinders PBMC stimulated cytokine responses compared to the protease-treated ProTIA in which the EpCAM×anti-CD3 portion is released from the composition.

Example 13: Anti-Tumor Properties of Anti-EpCAM×Anti-CD3 Protease Triggered Immune Activator (ProTIA) Composition in Early Treatment HCT-116 Model In vivo efficacy experiment was performed in immunodeficient NOD/SCID mice, characterized by the deficiency of T and B cells, and impaired natural killer cells. Mice were maintained in sterile, standardized environmental conditions and experiment performed in accordance with the Association for Assessment and Accreditation of Laboratory Animal Care (AAALAC) guidelines. The efficacy of protease-treated and protease-untreated anti-EpCAM×anti-CD3 ProTIA (AC1476) together with non-cleavable anti-EpCAM×anti-CD3 ProTIA (i.e. ProTIA without the release segment cleavage sequence and an example of which being AC1484) was evaluated using the human HCT-116 colorectal carcinoma xenograft model. Briefly, on day 0, four cohorts of 5 NOD/SCID mice per group were subcutaneously injected in the right flank with 5×10$^6$ human PBMC mixed with 5×10$^6$ HCT-116 cells. An hour after HCT-116/PBMC inoculation and based on equimolar dosing, cohort 1 was injected with vehicle (PBS+0.05% Tween 80), cohort 2 with 0.21 mg/kg protease-treated anti-EpCAM×anti-CD3 ProTIA, cohort 3 with 0.5 mg/kg protease-untreated anti-EpCAM×anti-CD3 ProTIA and cohort 4 with 0.49 mg/kg non-cleavable anti-EpCAM×anti-CD3 ProTIA. Cohort 1 to 4 were all subjected to four additional doses administered daily from day 1 to 4.

Tumors were measured twice per week for a projected 35 days with a caliper in two perpendicular dimensions and tumor volumes were calculated by applying the (width$^2$×length)/2 formula. Body weight, general appearance and clinical observations such as seizures, tremors, lethargy, hyper-reactivity, pilo-erection, labored/rapid breathing, coloration and ulceration of tumor and death were also closely monitored as a measure of treatment related toxicity. Study endpoint was defined as a tumor volume of 12002000 mm$^3$ or survival to 35 days, whichever comes first. Percent tumor growth inhibition index (% TGI) was calculated for each of the treatment group by applying the formula: ((Mean tumor volume of PBS control−Mean tumor volume of ProTIA treatment)/mean tumor volume of PBS control)×100. Treatment group with % TGI≥60% is considered therapeutically active.

Figure 38:
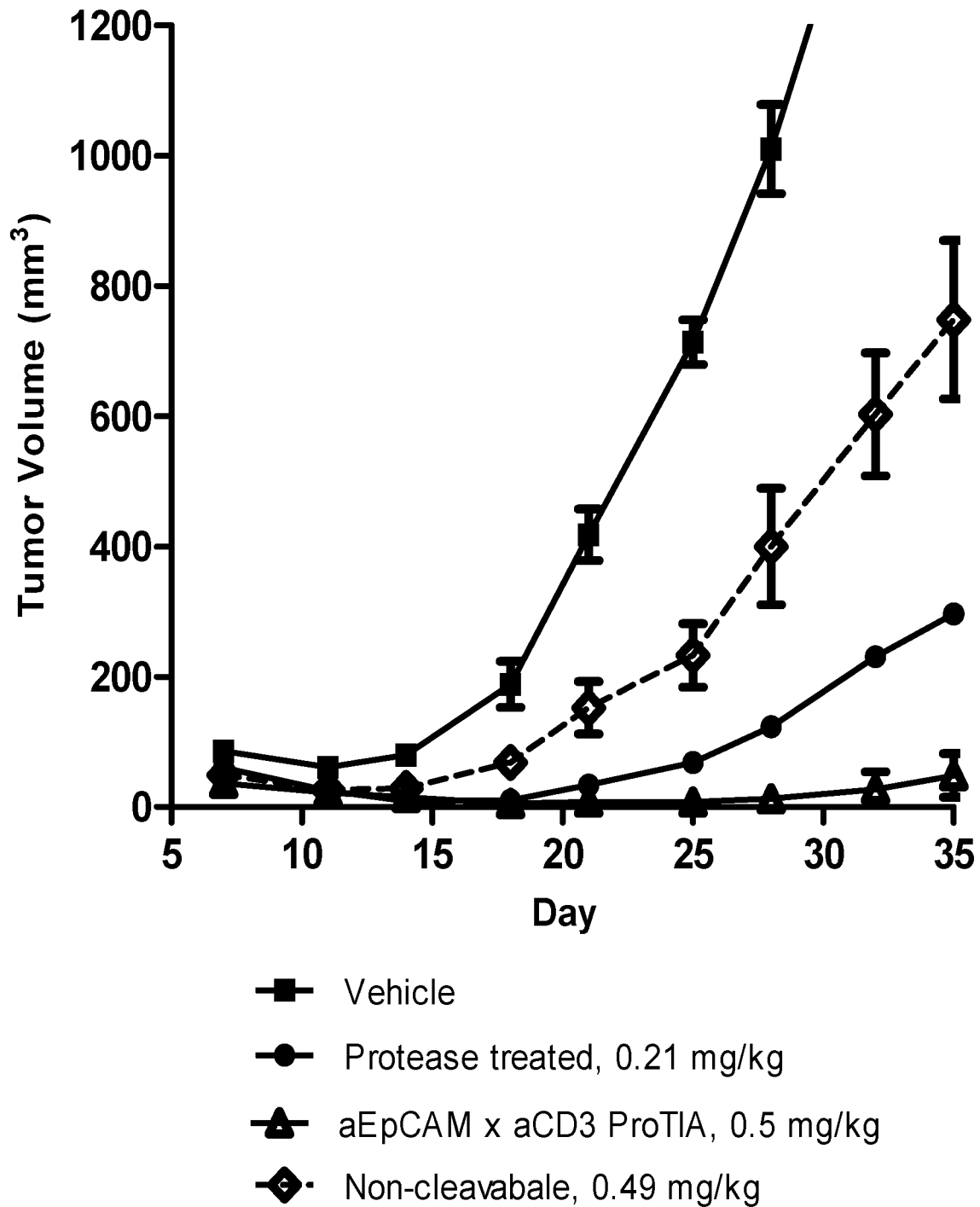
FIG. 38 depicts HCT-116 tumor volume results from experiment to determine the anti-tumor effect of anti-EpCAM×anti-CD3 ProTIA, protease-treated anti-EpCAM×anti-CD3 ProTIA and non-cleavable anti-EpCAM×anti-CD3 ProTIA, as described in Example 13.

At day 35, cohort 1 mice treated with vehicle in the presence of human effector cells did not inhibit tumor progression and exiting the study with a group mean tumor volume of 1654±87 mm$^3$, demonstrating that human effector cells alone as such could not elicit an anti-tumor effect. Treatment with the protease-treated anti-EpCAM×anti-CD3 ProTIA at 0.21 mg/kg (cohort 2) in the presence of human effector cells exhibited robust suppression of tumor growth; with 2/5 mice exhibiting complete tumor regression by displaying no measureable tumor volume at day 18. However, tumor regrowth and progression was observed from day 25 onwards in this cohort resulting in all 5 mice bearing a tumor burden exiting the study with a mean tumor volume of 296±33 mm$^3$ at day 35. Significantly, treatment with intact anti-EpCAM×anti-CD3 ProTIA at 0.5 mg/kg (cohort 3) in the presence of human effector cells also imparted strong inhibition of tumor growth. In fact 4/5 mice in cohort 3 exhibited complete tumor regression by day 18. With 2 mice still retaining complete regression on day 35, this cohort existed the study with mean tumor volume of 48±67 mm$^3$. Importantly, Cohort 4 subjected to 0.49 mg/kg dose of non-cleavable anti-EpCAM×anti-CD3 ProTIA, did not induce any sustained inhibition of tumor progression as effectively as cohort 2 and 3, leaving 5/5 mice in this cohort with significant tumor burden. Cohort 4 exited study at day 35 with a group mean tumor volume of 748±272 mm$^3$. Both protease-treated anti-EpCAM×anti-CD3 ProTIA at 0.21 mg/kg (cohort 2) and intact anti-EpCAM×anti-CD3 ProTIA at 0.5 mg/kg (cohort 3) are considered therapeutically active with a TGI of 82% and 97% respectively. With a TGI of 55%, the non-cleavable anti-EpCAM×anti-CD3 ProTIA is considered therapeutically inactive. As expected, the group mean tumor volume of intact anti-EpCAM×anti-CD3 ProTIA is found to be significantly different from that of non-cleavable anti-EpCAM×anti-CD3 ProTIA cohort (student's t-test, p=0.0016). Appreciably, the group mean tumor volume of intact anti-EpCAM×anti-CD3 ProTIA cohort is also found to be significantly different from that of protease-treated anti-EpCAM×anti-CD3 ProTIA cohort (p=0.002). Results suggest that at 0.5 mg/kg, significant amount of anti-EpCAM×anti-CD3 ProTIA was effectively cleaved by proteases present in the in vivo HCT-116 tumor environment to the highly active, unXTENylated anti-EpCAM×anti-CD3 moiety to impart the remarkable observed tumor regression. This hypothesis is very much supported by the non-cleavable anti-EpCAM×anti-CD3 ProTIA molecule lacking the release segment substrate that resulted in the lack of sustained tumor regression property (FIG. 38). Importantly, data also suggest that the anti-EpCAM×anti-CD3 ProTIA levied better therapeutic exposure than protease-treated anti-EpCAM×anti-CD3 ProTIA therefore reporting a more sustained tumor regression effect.

Figure 39:
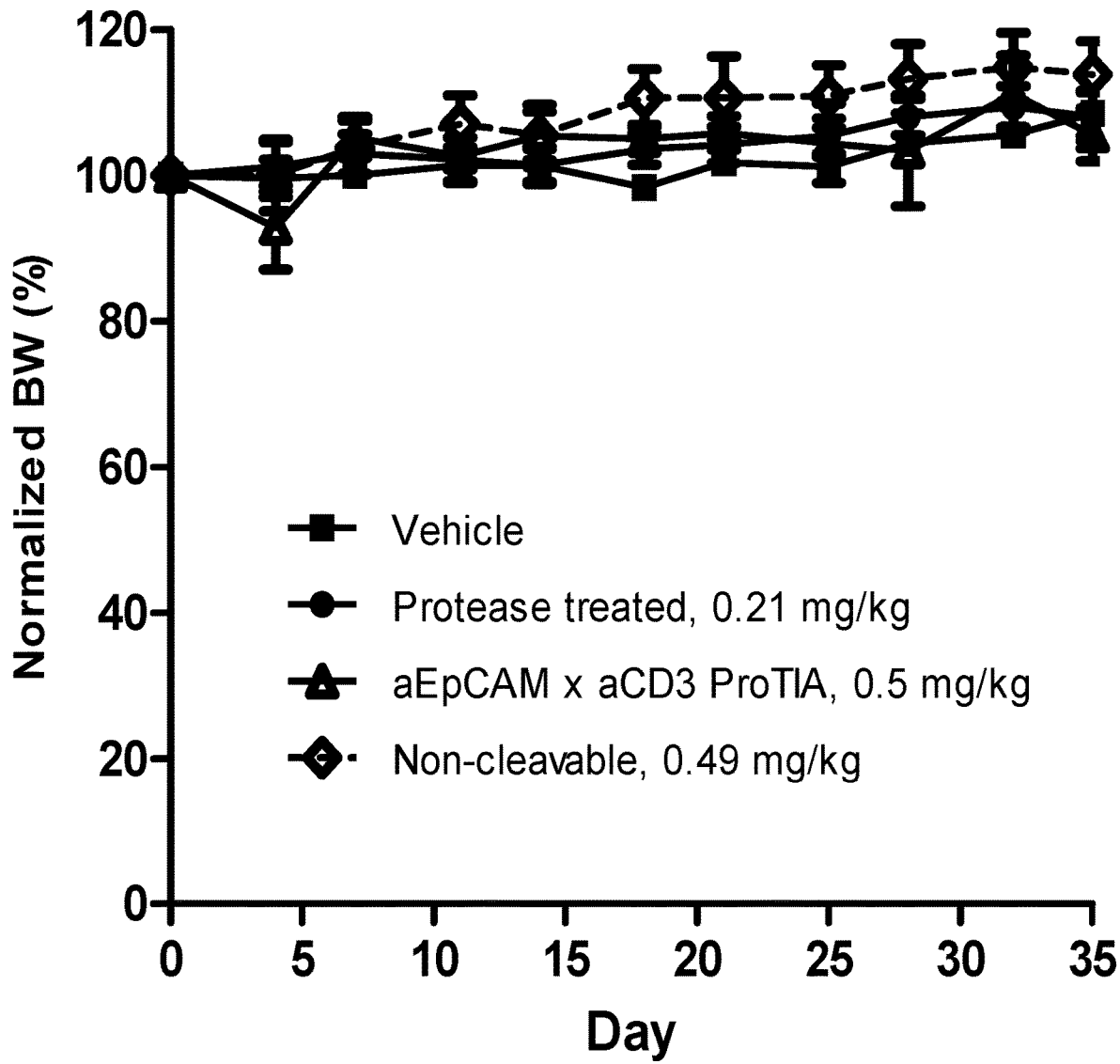
FIG. 39 depicts body weight results from experiment to determine the anti-HCT-116 tumor effect of anti-EpCAM×anti-CD3 ProTIA, protease-treated anti-EpCAM×anti-CD3 ProTIA and non-cleavable anti-EpCAM×anti-CD3 ProTIA, as described in Example 13.

Of note, no significant body weight loss was observed in all ProTIA treatment groups and vehicle control indicating that all treatments were generally well tolerated (FIG. 39).

Figure 40:
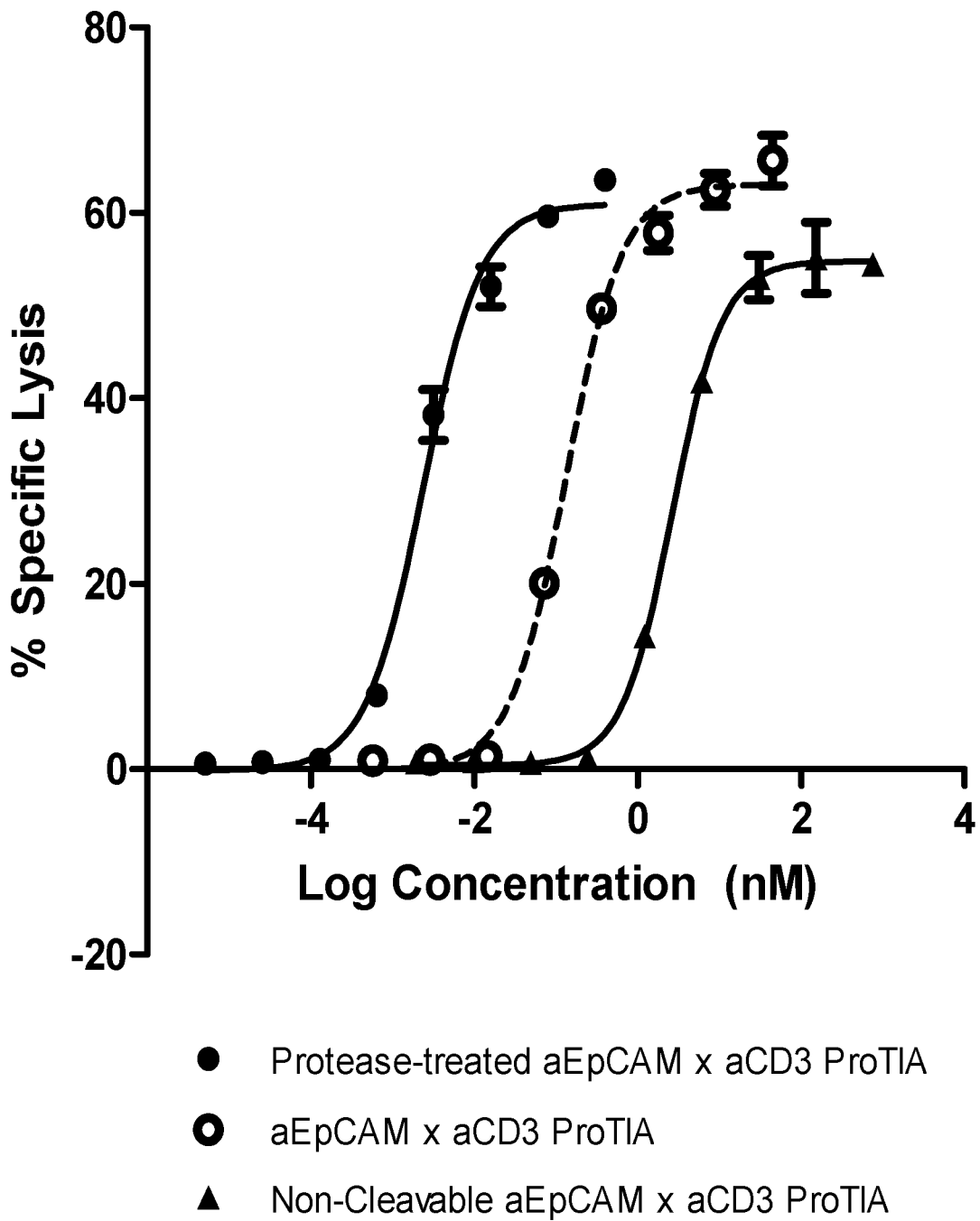
FIG. 40 depicts results from the experiment to determine the in vitro activity of protease-treated, protease-untreated and protease-non cleavable anti-EpCAM×anti-CD3 ProTIA in SK-OV-3 with human purified CD3 positive T cells as described in Example 14.
Figure 41:
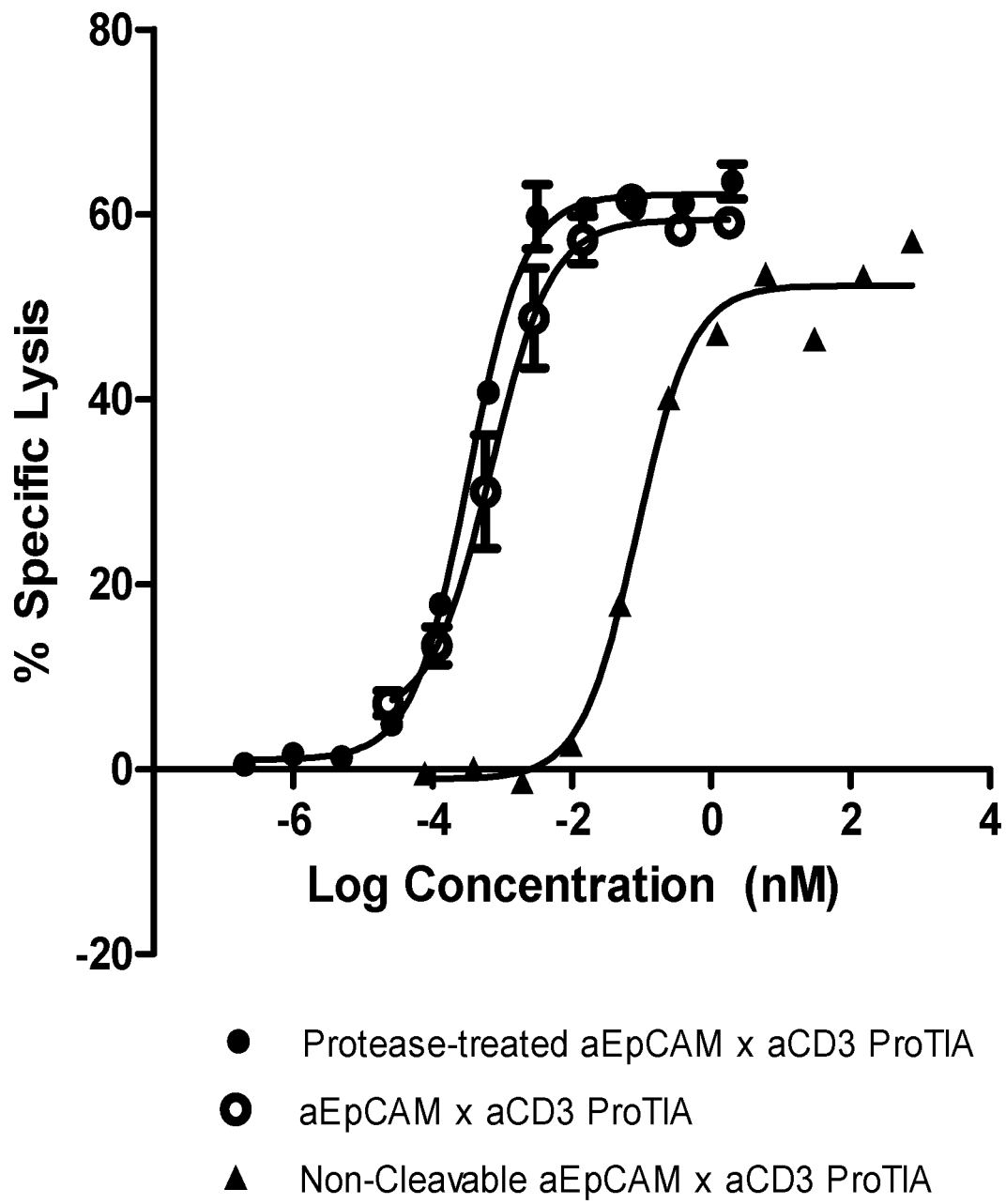
FIG. 41 depicts results from the experiment to determine the in vitro activity of protease-treated, protease-untreated and protease-non cleavable anti-EpCAM×anti-CD3 ProTIA in OVCAR-3 with human purified CD3 positive T cells as described in Example 14.

Example 14: Cytotoxicity Assays of Anti-EpCAM×Anti-CD3 Protease Triggered Immune Activator (ProTIA) Composition in the Presence of Purified CD3 Positive T Cells To demonstrate that cytotoxic activity of ProTIA molecules is mediated by CD3 positive T cells, non-cleavable anti-EpCAM×anti-CD3 ProTIA without the release segment (AC1484) and protease-treated and untreated anti-EpCAM×anti-CD3 ProTIA (AC1476) were further evaluated in SK-OV-3 and OVCAR-3 human ovarian cell lines in the presence of purified human CD3 positive T cells. Purified human CD3 positive T cells were purchased from Bioreclamation-IVT and isolated by negative selection using MagCellect Human CD3+ T cell isolation kit from whole blood of healthy donors. In this experiment, purified human CD3 positive T cells were mixed with SK-OV-3 or OVAR-3 ovarian cells in a ratio of 5:1 and all three ProTIA molecules were tested as a 12-point, 5× serial dilution dose curve in the LDH assay as described above. As expected, the activity trend of the three ProTIA molecules profiled in SK-OV-3 was found to be similar to that observed in the SK-OV-3 with PBMC analysis (FIG. 30). In the cytotoxic killing of SK-OV-3 ovarian cells by human CD3 positive T cells, untreated anti-EpCAM×anti-CD3 ProTIA is 56-fold less active than protease-treated ProTIA ($EC_{50}$ of 134 pM vs. 2.4 pM); and the non-cleavable anti-EpCAM×anti-CD3 ProTIA is >1000-fold less active than the protease-cleaved ProTIA ($EC_{50}$ of 2660 pM vs. 2.4 pM) (FIG. 40). In the cytotoxic killing of OVCAR-3 ovarian cells by human CD3 positive T cells, untreated anti-EpCAM×anti-CD3 ProTIA is only 2-fold less active than protease-treated ProTIA ($EC_{50}$ of 0.7 pM vs. 0.3 pM); and the non-cleavable anti-EpCAM×anti-CD3 ProTIA is 287-fold less active than the protease-cleaved ProTIA ($EC_{50}$ of 86 pM vs. 0.3 pM) (FIG. 41). Results demonstrated that cytotoxic activity of ProTIA molecules is indeed mediated by CD3 positive T cells; and that the susceptibility of the release segment contained within the cleavable anti-EpCAM×anti-CD3 ProTIA molecule to proteases postulated to be released from the tumor cells and/or activated CD3 positive T cells in the assay mixture is likely to differ between cell lines.

Example 15: T-Cell Activation Marker and Cytokine Release Assays of Anti-EpCAM×Anti-CD3 Protease Triggered Immune Activator (ProTIA) Composition To measure the anti-EpCAM×anti-CD3 ProTIA induced expression of cytokines, $1\times10^5$ purified CD3+ cells were co-cultured with $2\times10^4$ SK-OV-3 cells per assay well (i.e., effector to target ratio of 5:1) in the presence of anti-EpCAM×anti-CD3 ProTIA (AC1476) in a 96-well round-bottom plate with total final volume of 200 microL. After 20 h incubation in a 37° C., 5% $CO_2$ humidified incubator, cell supernatant was harvested for cytokine measurements. This assay can also be performed with other target cells selected from HCT-116, Kato III, MDA-MB-453, MCF-7, MKN45, MT3, NCI-N87, SK-Br-3, SW480, OVCAR3 and PC3 cell lines as well as PBMC in place of purified CD3+ cells.

Cytokine analysis of interleukin (IL)-2, IL-4, IL-6, IL-10, tumor necrosis factor (TNF)-alpha and interferon (IFN)-gamma secreted into the cell culture supernatant was quantitated using the Human Th1/Th2 Cytokine Cytometric Bead Array (CBA) kit (BD Biosciences cat #550749) following manufacturer's instruction. In the absence of ProTIA, no cytokine secretion above background is expected from purified CD3+ cells. ProTIA in the presence of EpCAM-positive target cells and purified CD3+ cells is expected to activate T cells and secrete a pattern of T cell cytokines with a high proportion of Th1 cytokines such as IFN-gamma and TNF-alpha.

As expected, anti-EpCAM×anti-CD3 ProTIA induced robust secretion of all cytokines (IL-2, IL-4, IL-6, IL-10, TNF-alpha, IFN-gamma) evaluated (see FIGS. 50-52). Stimulation of purified CD3+ cells with SK-OV-3 cells and protease-treated anti-EpCAM×anti-CD3 ProTIA (MMP-9 treated AC1476) triggered significant cytokine expression, especially at concentrations higher than 20 pM for all of the cytokines tested. In contrast, baseline levels of IL-2, IL-4, IL-6, IL-10, TNF-alpha and IFN-gamma were detected when the intact non-cleaved anti-EpCAM×anti-CD3 ProTIA molecule (AC1476) was used at a concentration range of 8 to 200 pM ($EC_{50}$ of 4.3 nM). Additionally, baseline levels of all cytokines tested were detected when the non-cleavable anti-EpCAM×anti-CD3 ProTIA molecule (AC1484) was used at a concentration range of 40 p M to 1 nM. These data suggest that the XTEN polymer of the intact ProTIA composition provides considerable shielding effect and hinders CD3+ T-cell stimulated cytokine responses compared to the protease-treated ProTIA in which the EpCAM×anti-CD3 portion is released from the composition.

Example 16: CD3 Binding Specificity of Anti-EpCAM×Anti-CD3 Protease Triggered Immune Activator (ProTIA) Composition As ProTIA is a bispecific-targeting composition, the binding capability of anti-EpCAM×anti-CD3 ProTIA composition was also evaluated for binding affinity to human CD3. This was determined with a CD3ε & δ/peroxidase-conjugated protein-L sandwich ELISA. In this ELISA, recombinant human CD3 (rhCD3ε & δ) (Creative BioMart cat #CD3E&CD3D-219H) was coated on a 96-well, flat-bottomed plate at a concentration of 0.025 microg/100 microL. After overnight incubation at 4° C., the assay plate was washed and blocked with 3% bovine serum albumin (BSA) for 1 h at room temperature. The plate was washed again followed by the introduction of dose ranges of non-cleavable anti-EpCAM×anti-CD3 ProTIA (AC1484), protease-treated and protease-untreated anti-EpCAM×anti-CD3 ProTIA (AC1476). The dose range utilized for all three versions of ProTIA was 0.002 to 100 nM, achieved with a 1:6 fold serial dilution scheme from a starting concentration of 100 nM. The plate was allowed to incubate with shaking for 1 h at room temperature to allow the non-cleavable, protease-cleaved and protease-untreated ProTIA to bind to the rhCD3ε & δ coated on the plate. Unbound components were removed with a wash step and a peroxidase-conjugated protein L (ThermoFisher Scientific cat #32420) at 0.05 microg/100 microL was added. After an appropriate incubation period, any unbound reagent was removed by a wash step followed by the addition of tetramethylbenzidine (TMB) substrate to each well. After desired color intensity was reached, 0.2 N sulfuric acid was added to stop the reaction and absorbance (OD) was measured at 450 nm using a spectrophotometer. The intensity of the color is proportional to the concentration of non-cleavable, protease-treated and untreated anti-EpCAM×anti-CD3 ProTIA captured by the rhCD3ε & δ/protein-L sandwich ELISA. The intensity of the color produced (measured OD) was plotted against protein concentration; and the concentration of non-cleavable, protease-cleaved and uncleaved anti-EpCAM× anti-CD3 ProTIA that gave half-maximal response ($EC_{50}$) was derived with a 4-parameter logistic regression equation using GraphPad prism software.

Figure 53:
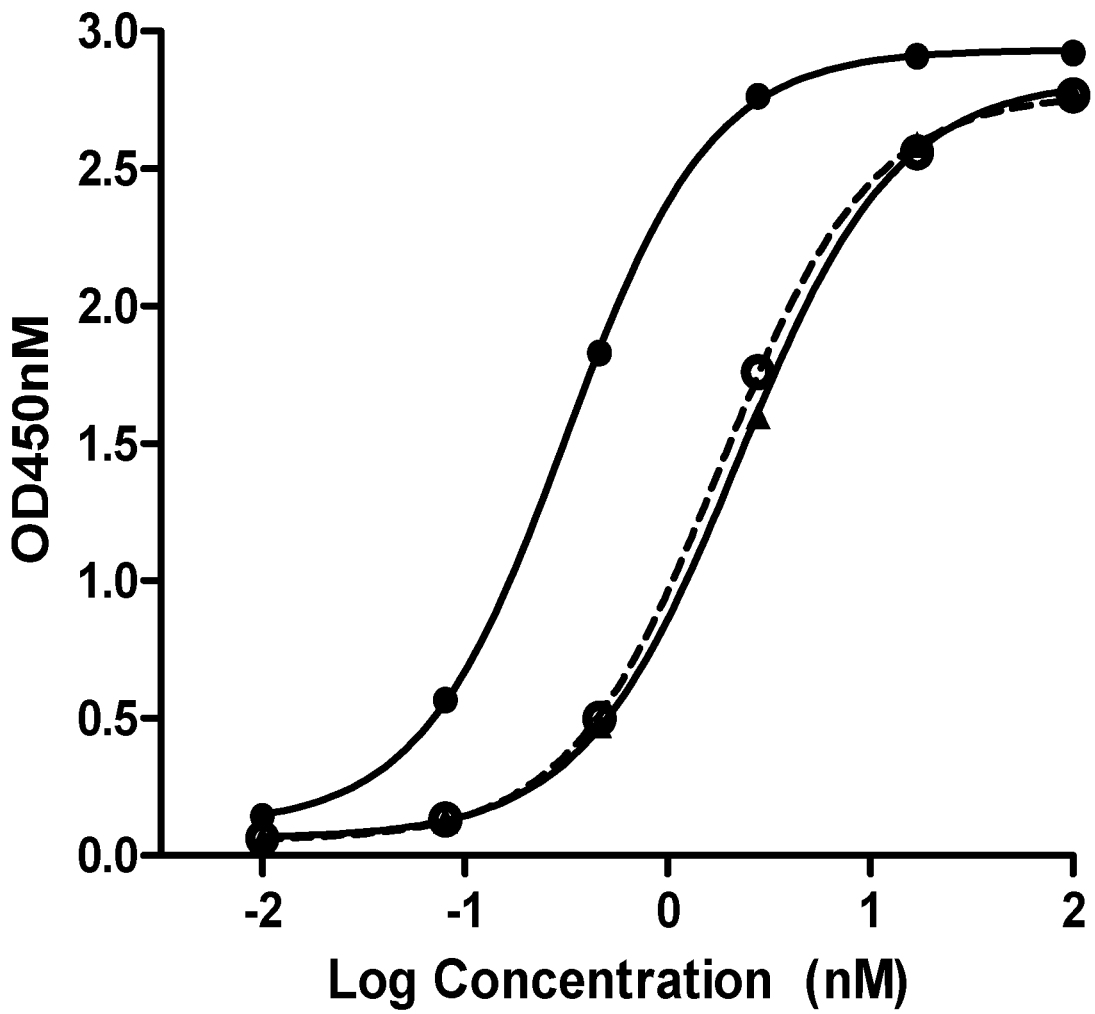
FIG. 53 shows the binding curves of protease-treated, protease-untreated and noncleavable antiEpCAM×antiCD3 ProTIA for CD3εδ ligands, as described in Example 16.

Results: As shown in FIG. 53, the protease-untreated anti-EpCAM×anti-CD3 ProTIA had a binding activity similar to that of non-cleavable anti-EpCAM×anti-CD3 bispecific ProTIA molecule each bearing an $EC_{50}$ of 1800 pM and 2200 pM respectively. The protease-treated ProTIA had the strongest binding activity at $EC_{50}$ of 310 pM for the rhCD3ε & δ ligand compared to the intact protease-untreated bispecific molecule or the non-cleavable ProTIA molecule. As the XTEN864 blocking moiety is located right after the anti-CD3scFv moiety, the XTEN864 results in hindrance in the binding of the non-cleaved anti-CD3 entity for its ligand by ~5.8 fold as compared to the cleaved and released anti-CD3scFv portion of the ProTIA binding to the CD3 ligand.

Example 17: Binding Specificity of Anti-EpCAM×Anti-CD3 Protease Triggered Immune Activator (ProTIA) Composition The binding specificity of an anti-EpCAM×anti-CD3 ProTIA (AC1476) was evaluated in conjunction with the control ProTIA compositions anti-CEA×anti-CD3 ProTIA (AC1432) and anti-HER2×anti-CD3 ProTIA (AC1408), in a target cell marker/biotin-conjugated protein-L sandwich ELISA. Both the anti-CEA×anti-CD3 ProTIA (AC1432) and the anti-HER2×anti-CD3 ProTIA (AC1408) bear the same anti-CD3 scFv component as the anti-EpCAM×anti-CD3 ProTIA (AC1476) albeit with different targeting component. In the ELISA binding assay, recombinant human EpCAM (rhEpCAM) (R&D Systems cat #960-EP-50), recombinant human CEA (Abcam cat #ab742) and recombinant human HER2 (AcroBiosystems cat #HE2-H525) were coated on a 96-well, flat-bottomed plate at a concentration of 0.1 microg/100 microL. After overnight incubation at 4° C., the assay plate was washed and blocked with 3% bovine serum albumin (BSA) for 1 h at room temperature. The plate was washed again followed by the introduction of a dose range (0.0007 to 0.5 nM, achieved with a 1:3 fold serial dilution scheme from a starting concentration of 0.5 nM) of protease-treated anti-EpCAM×anti-CD3 ProTIA (AC1476) to EpCAM-coated wells, CEA-coated wells and HER2-coated wells. Serving as controls, protease-treated anti-CEA×anti-CD3 ProTIA (AC1432) was introduced at a similar dose range onto CEA-coated wells, and protease-treated anti-HER2×anti-CD3 ProTIA (AC1408) was also introduced at a similar dose range onto HER2-coated wells. The plate was allowed to incubate with shaking for 1 h at room temperature to allow the various protease-cleaved ProTIAs to bind to the respective antigen coated on the plate. Unbound components were removed with a wash step and a biotin-conjugated protein L (ThermoFisher Scientific cat #29997) was added at 0.05 microg/100 microL. After an appropriate incubation period, any unbound reagent was removed by a wash step followed by the addition of tetramethylbenzidine (TMB) substrate to each well. After desired color intensity was reached, 0.2 N sulfuric acid was added to stop the reaction and absorbance (OD) was measured at 450 nm using a spectrophotometer. The intensity of the color is proportional to the concentration of the respective protease-treated ProTIAs captured by the appropriate antigen coated on the plate. The intensity of the color produced (measured OD) was plotted against ProTIA concentration; and the respective dose curve derived with a 4-parameter logistic regression equation using GraphPad prism software.

Figure 54:
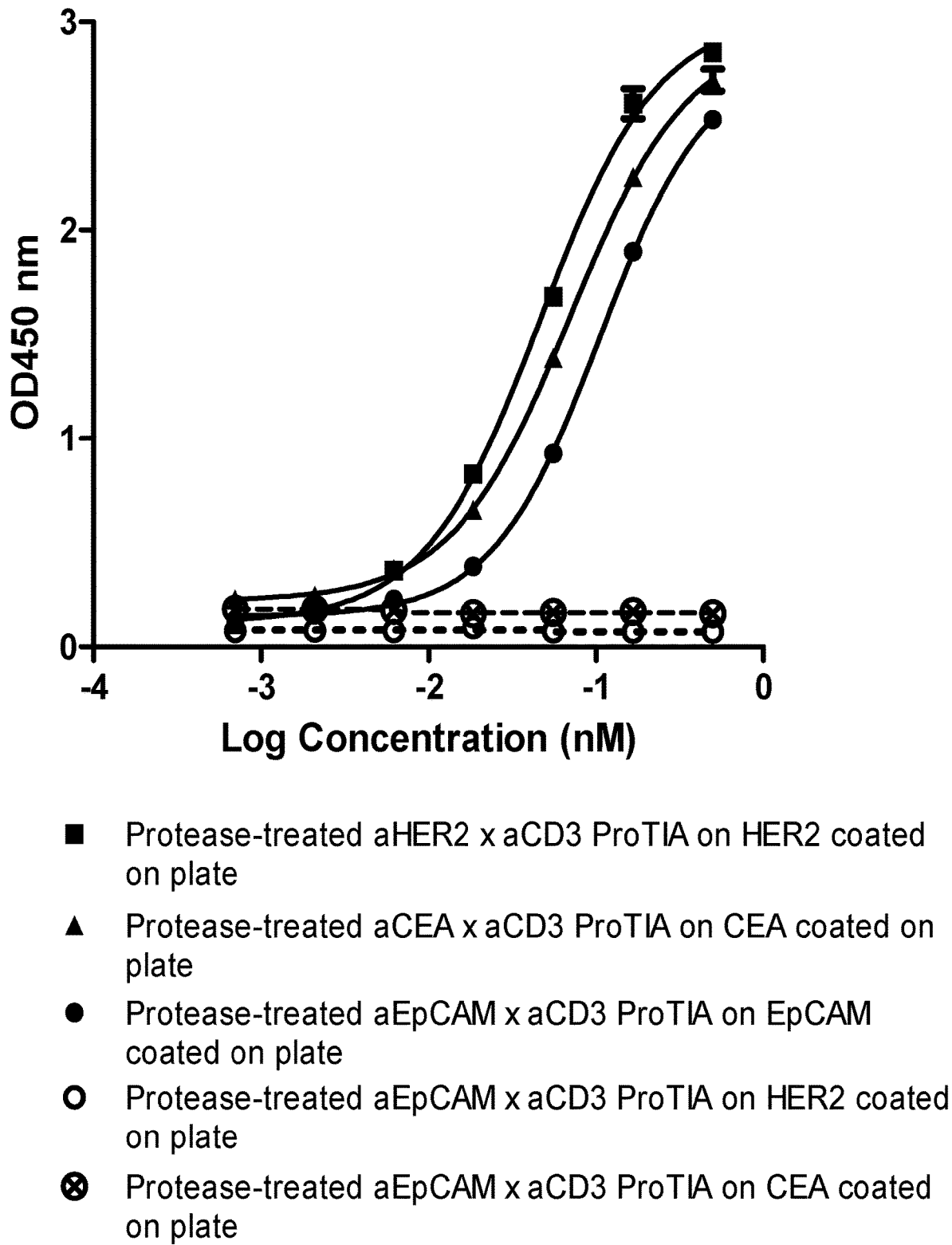
FIG. 54 shows binding specificity of protease treated antiEpCAM×antiCD3 ProTIA for rhEpCAM ligand, as described in Example 17.

Results: As shown in FIG. 54 (and comparable with the results of FIG. 24), protease-treated anti-EpCAM×anti-CD3 ProTIA binds on rhEpCAM coated on the plate in a dose-dependent manner to yield an $EC_{50}$ of 110 pM. Similarly, protease-treated anti-CEA×anti-CD3 ProTIA binds to the CEA antigen coated on the plate in a dose-dependent manner to yield an $EC_{50}$ of 70 pM; and protease-treated anti-HER2×anti-CD3 ProTIA binds to the HER2 antigen coated on the plate in a dose-dependent manner to yield an $EC_{50}$ of 47 pM. Significantly, no dose-dependent binding was observed for protease-treated anti-EpCAM×anti-CD3 ProTIA binding to both CEA- and HER2-antigen coated on the plate indicating that protease-treated anti-EpCAM×anti-CD3 ProTIA binds specifically to EpCAM but not to CEA or HER2 antigen. Thus, the compositions exhibited specific binding affinity to their target ligands and no non-specific binding.

Example 18: Anti-Tumor Properties of Intact Anti-EpCAM×Anti-CD3 ProTIA Versus Non-Cleavable Anti-EpCAM×Anti-CD3 ProTIA in Early Treatment SW480 Model The protease susceptibility of the Release Segment (RS) as engineered into the anti-EpCAM×anti-CD3 ProTIA molecule (AC1476) in tumor environment was also evaluated in vivo together with non-cleavable anti-EpCAM×anti-CD3 ProTIA (AC1484), protease-treated and protease-untreated anti-EpCAM×anti-CD3 ProTIA (AC1476) in the SW480/PBMC inoculated NOD/SCID xenograft model. Much like the study described in Examples 10 and 13, an hour after SW480/PBMC inoculation (denoted as day 0), cohort 1 mice was injected with vehicle (PBS_0.05% Tween 80), cohort 2 with 0.21 mg/kg protease-treated anti-EpCAM×anti-CD3 ProTIA, cohort 3 with 0.5 mg/kg intact anti-EpCAM×anti-CD3 ProTIA and cohort 4 with 0.49 mg/kg non-cleavable anti-EpCAM×anti-CD3 ProTIA. All cohorts (i.e. 1 to 4) were further treated with four additional doses administered daily from day 1 to day 4. Tumor volume, body weight and clinical observations are monitored two times per week for a targeted 35 days.

Figure 55:
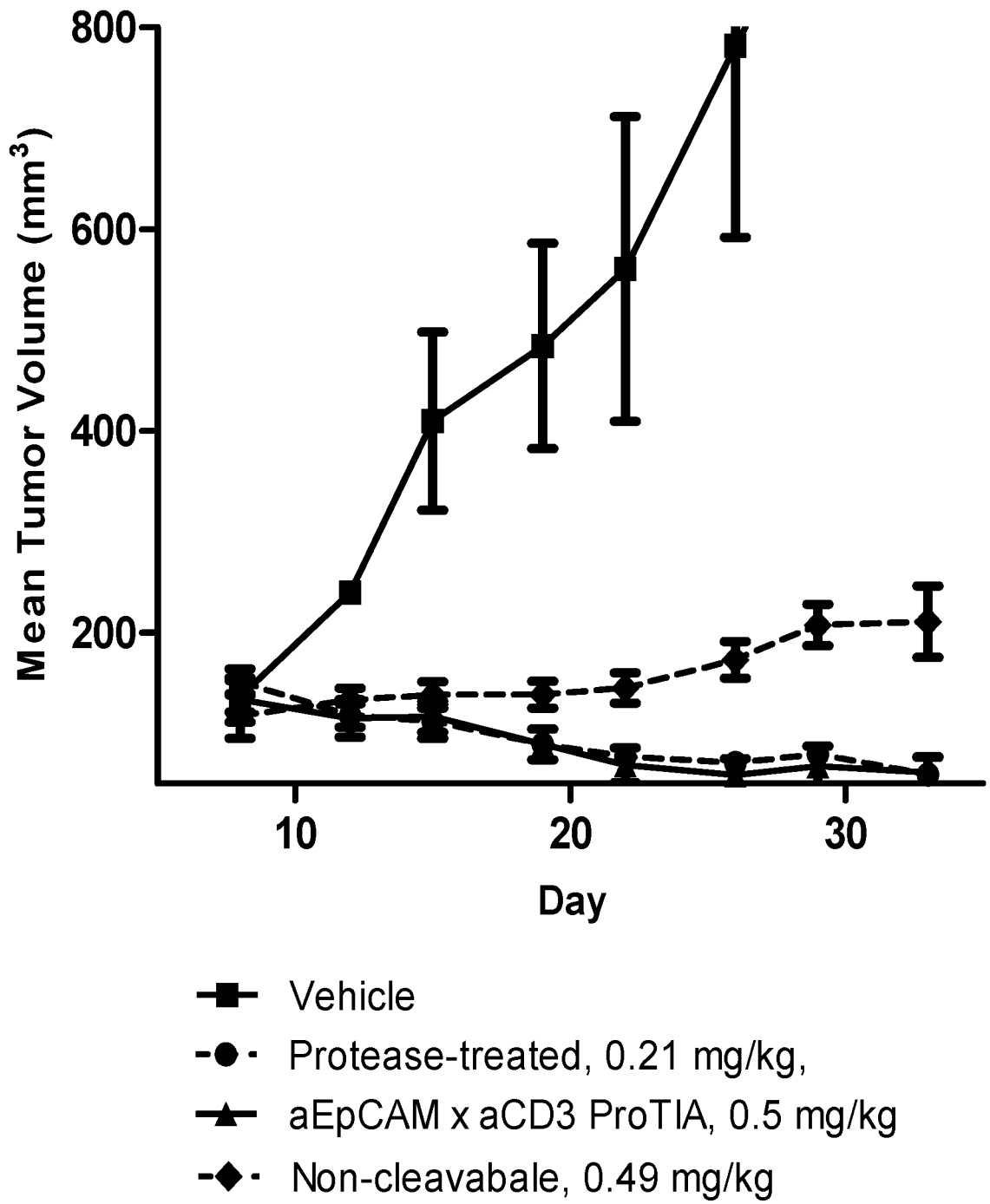
FIG. 55 depicts SW480 tumor volume results from the experiment to determine the antitumor effect of antiEpCAM×antiCD3 ProTIA, protease treated antiEpCAM×antiCD3 ProTIA and noncleavable antiEpCAM×antiCD3 ProTIA, as described in Example 18.

As shown in FIG. 55, protease-treated anti-EpCAM×anti-CD3 ProTIA at 0.21 mg/kg (cohort 2), intact anti-EpCAM×anti-CD3 ProTIA at 0.5 mg/kg (cohort 3) and non-cleavable anti-EpCAM×anti-CD3 ProTIA at 0.49 mg/kg (cohort 4) are all determined to be therapeutically active with a tumor growth inhibition index (% TGI) of 93%, 95% and 80% respectively. Thus, dosed at equimolar, intact anti-EpCAM×anti-CD3 ProTIA is effectively cleaved by tumor-enriched proteases to the highly active released anti-EpCAM×anti-CD3 (not linked to the XTEN moiety) to display equivalent tumor regression efficacy as protease-treated anti-EpCAM×anti-CD3 ProTIA. As expected, though efficacious in inhibiting tumor progression, the non-cleavable anti-EpCAM×anti-CD3 ProTIA is less effective than intact anti-EpCAM×anti-CD3 ProTIA indicating that the presence of the release segment improved therapeutic efficacy of the composition by permitting the release of the anti-EpCAM×anti-CD3 binding domains.

Figure 56:
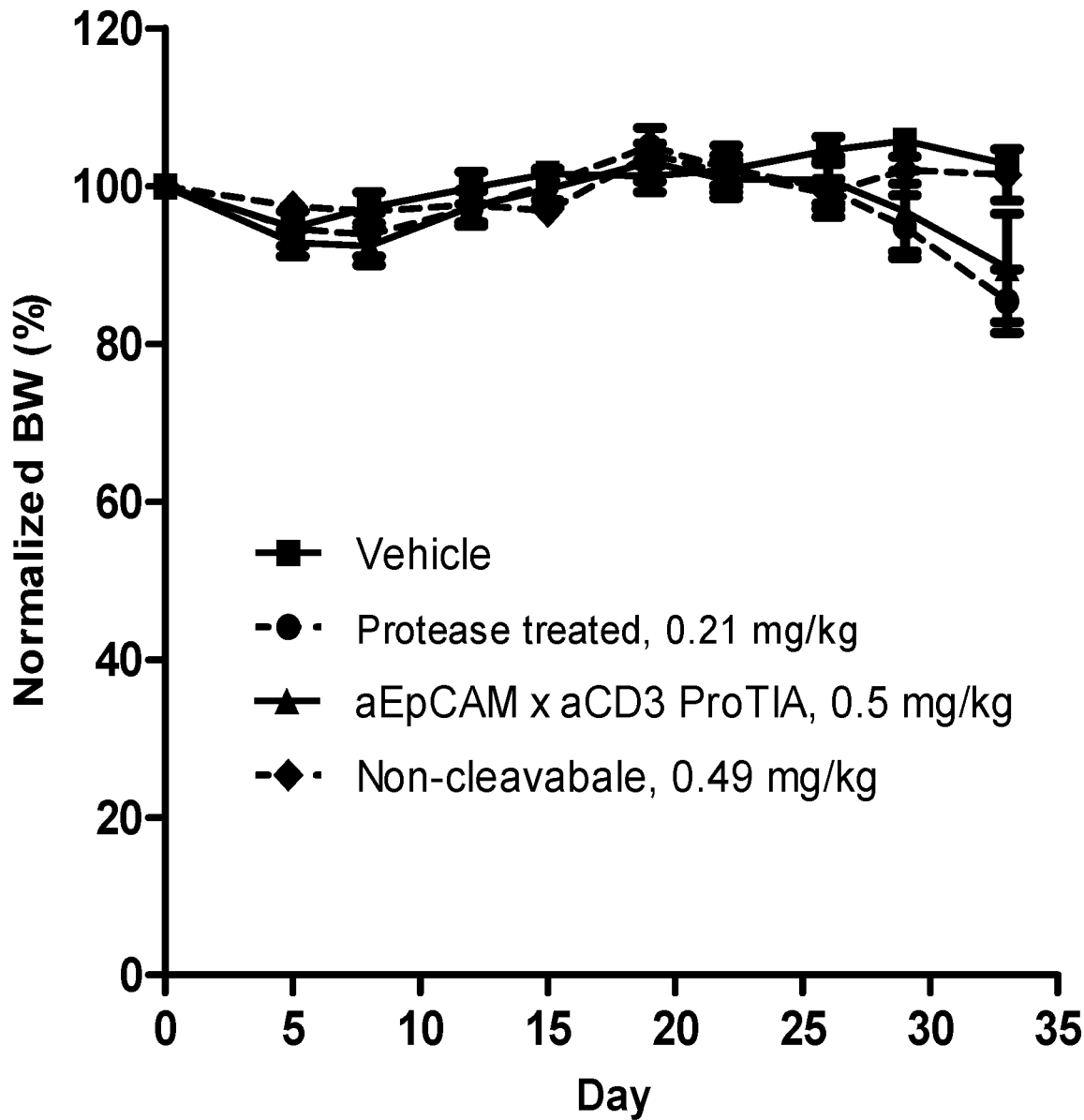
FIG. 56 depicts body weight results from the experiment to determine the antiSW480 tumor effect of antiEpCAM×antiCD3 ProTIA, protease-treated antiEpCAM×antiCD3 ProTIA and noncleavable antiEpCAM×antiCD3 ProTIA, as described in Example 18.

As shown in FIG. 56, some body weight loss was observed in cohort 2 and 3 in the SW480 xenograft model, suggesting some possible toxicity. Additional experiments evaluating minimum effective dose, reduced number of dosing and evaluation in established tumor model will shed more light on this initial observation.

Example 19: Anti-Tumor Properties of Anti-EpCAM×Anti-CD3 Protease Triggered Immune Activator (ProTIA) Composition in OVCAR-3 Ovarian Model The in vivo efficacy of anti-EpCAM×anti-CD3 ProTIA is also evaluated using the human ovarian OVCAR-3 cell line implanted intraperitoneally into the severely immunodeficient NSG (NOD.Cg-Prkdc$^{scid}$.IL2rg$^{tm1Wjl}$/SzJ) or NOG (NOD/Shi-scid/IL-2Rg$^{null}$ mice. NOG and NSG mice are characterized by the deficiency of T, B and NK cells, as well as the dysfunction of macrophages, dendritic cell and complement system. Briefly, on day 0, seven cohorts of 5 NOG or NSG mice per group are implanted intraperitoneally with 5-10×10$^6$ OVCAR-3 cells, followed by the intravenous introduction of 5-10×10$^6$ of PBMC on day 14. On day 16, treatment is initiated with cohort 1 injected with vehicle (PBS+0.05% Tween 80) daily for 5 doses (qdx5), cohort 2 with 0.21 mg/kg protease-treated anti-EpCAM×anti-CD3 ProTIA qdx5, cohort 3 with 1.05 mg/kg protease-treated anti-EpCAM×anti-CD3 ProTIA once per week (qw), cohort 4 with 0.5 mg/kg with protease-untreated anti-EpCAM×anti-CD3 ProTIA qdx5, cohort 5 with 2.5 mg/kg with protease-untreated anti-EpCAM×anti-CD3 ProTIA qw, cohort 6 with 0.49 mg/kg non-cleavable anti-EpCAM×anti-CD3 ProTIA qdx5 and cohort 7 with 2.45 mg/kg noncleavable anti-EpCAM×anti-CD3 ProTIA qw. All cohorts are subjected to another cycle of treatment the following week. Mice are monitored daily for behavior and survival, and twice weekly for body weight and abdomen distention. Blood are collected on day 30, day 40, day 50 and day 60 for CA125 determination as sign of tumor development. When weight of animals has increased by 30% from day 0, the animal is defined as having met study endpoint and is sacrificed and autopsied.

Growth of OVCAR-3 tumor is evidenced by the development of intraperitoneal ascites as monitored by increase in body weight, increase in abdomen diameter and an increase in circulating CA125 levels. It is expected that both protease-cleaved and protease-untreated anti-EpCAM×anti-CD3 ProTIA (e.g. AC1684, AC1685, AC1686, AC1693, AC1695, AC1714, and AC1715) will lead to improve survival and an absence or delay of ascites formation. It is also expected that the protease-untreated ProTIA will have a better therapeutic exposure leading to a more efficacious anti-tumor effect and better safety profile than protease-treated ProTIA. The non-cleavable anti-EpCAM×anti-CD3 ProTIA is also expected to retard tumor growth but to a much lesser extent than that demonstrated by the release segment bearing protease-untreated and the protease-treated ProTIA.

Example 20: PK Properties of Anti-EpCAM×Anti-CD3 Protease Triggered Immune Activator (ProTIA) Composition in OVCAR-3 Ovarian Model Protease-cleaved, protease-untreated and non-cleavable anti-EpCAM×anti-CD3 ProTIAs' PK and bio-distribution profile is evaluated as a mixture of independently metal-labeled molecules in the OVCAR-3 tumor bearing BALB/c nude mice. To each irradiated BALB/c nude mice, ten million OVCAR-3 cells are injected intraperitoneally on day 0. Treatment is initiated when abdominal distention is visibly observed and/or when animal body weight has increased by 10-15% over day 0. Out of twenty OVCAR-3 tumor bearing mice, 18 are selected and randomized according to their individual body weight into 2 groups of 9 animals per group. One group of 9 mice is intravenously injected with 1.5 mg/kg of the mixture comprising of equimolar concentration of metal 1-labeled protease-cleaved anti-EpCAM×anti-CD3 ProTIA, metal 2-labeled protease-untreated anti-EpCAM×anti-CD3 ProTIA and metal 3-labeled non-cleavable anti-EpCAM×anti-CD3 ProTIA. The other group of 9 animals is administered intraperitoneally with 1.5 mg/kg of the same ProTIA mixture.

By alternating between animals in the same group (i.e. intravenously and intraperitoneal administered groups), blood is collected by jugular/mandibular vein puncture into lithium heparin tubes at 0.5 h, 4 h, 8 h, 24 h, 48 h, day 3, day 5 and day 7 post-test article administration. Blood is processed into plasma by centrifugation at 1300 g for 10 minutes at 4° C. and stored at −80° C. till analysis.

Ascites is collected from both intravenously and intraperitoneal administered groups at 4 h, 8 h, 24 h, 48 h, day 3, day 5 and day 7 post-test article administrations by alternating between animals in the same group. Ascites samples are immediately centrifuged at 300 g for 10 minutes at 4° C. and fluid component frozen down at −80° C. until analysis.

Three mice from each group will be terminated on day 3, day 5 and day 7. Organs (brain, heart, liver, lung, spleen, and pancreas) and tumor nodules in the peritoneal cavity are harvested, weighed, flash frozen and stored at −80° C. until analysis is performed.

All samples (blood, ascites, normal organs and tumor tissues) are analyzed by ICP-MS (inductively coupled plasma mass spectrometry). In the intravenous arm, low amount of all 3 ProTIAs are expected to be detected in the ascites. In the plasma component, metal 2-labeled protease-untreated anti-EpCAM×anti-CD3 ProTIA and metal 3-labeled non-cleavable anti-EpCAM×anti-CD3 ProTIA are expected to demonstrate a longer systemic half-life than metal 1-labeled protease-cleaved anti-EpCAM×anti-CD3 ProTIA. In the intraperitoneal arm, all 3 ProTIA versions are expected to be detectable in the ascites. Due to the presence of tumor in the intraperitoneal space, it is unknown if metal 2-labeled protease-untreated anti-EpCAM×anti-CD3 ProTIA and metal 3-labeled non-cleavable anti-EpCAM×anti-CD3 ProTIA will have a longer retention time in the peritoneal cavity as compared to metal 1-labeled protease-cleaved anti-EpCAM×anti-CD3 ProTIA. All 3 ProTIA versions are expected to be detected in plasma at a delayed time and at a lower concentration as compared to the intravenous route. All 3 ProTIA versions are expected to be present at higher concentration in tumor nodules extracted from the peritoneal cavity but minimally or none in normal organs.

Example 21: Anti-Tumor Properties of Anti-EpCAM×Anti-CD3 Protease Triggered Immune Activator (ProTIA) Composition in SK-OV-3 Ovarian Model The in vivo efficacy of anti-EpCAM×anti-CD3 ProTIA is also evaluated using the human ovarian SK-OV-3 cell line implanted intraperitoneally into the severely immunodeficient NSG (NOD.Cg-Prkdc$^{scid}$.IL2rg$^{tm1Wjl}$/SzJ) or NOG (NOD/Shi-scid/IL-2Rg$^{null}$) mice. NOG and NSG mice are characterized by the deficiency of T, B and NK cells, as well as the dysfunction of macrophages, dendritic cell and complement system. Briefly, on day 0, seven cohorts of 5 NOG or NSG mice per group are implanted intraperitoneally with 5-10×10$^6$ SK-OV-3 cells, followed by the intraperitoneal introduction of 5-10×10$^6$ of PBMC on day 5. On day 7, treatment is initiated with cohort 1 injected with vehicle (PBS+0.05% Tween 80) daily for 5 doses (qdx5), cohort 2 with 0.21 mg/kg protease-treated anti-EpCAM×anti-CD3 ProTIA qdx5, cohort 3 with 1.05 mg/kg protease-treated anti-EpCAM×anti-CD3 ProTIA once per week (qw), cohort 4 with 0.5 mg/kg with protease-untreated anti-EpCAM× anti-CD3 ProTIA qdx5, cohort 5 with 2.5 mg/kg with protease-untreated anti-EpCAM×anti-CD3 ProTIA qw, cohort 6 with 0.49 mg/kg non-cleavable anti-EpCAM×anti-CD3 ProTIA qdx5 and cohort 7 with 2.45 mg/kg non-cleavable anti-EpCAM×anti-CD3 ProTIA qw. Mice are monitored daily for behavior and survival, and twice weekly for body weight and abdomen distention. When weight of animals has increased by 30% from day 0, animal is defined as having met study endpoint and are sacrificed and autopsied.

Growth of SK-OV-3 is evidenced by the development of intraperitoneally ascites monitored by increase in body weight and increase in abdomen diameter. It is expected that both protease-cleaved and protease-untreated anti-EpCAM× anti-CD3 ProTIA (e.g. AC1684, AC1685, AC1686, AC1693, AC1695, AC1714, and AC1715) will lead to improve survival and absence or delay of ascites formation. It is also expected that the protease-untreated ProTIA will impart better therapeutic exposure, a more efficacious antitumor effect and better safety profile than protease-treated ProTIA. The non-cleavable anti-EpCAM×anti-CD3 ProTIA is also expected to retard tumor growth but to a much lesser magnitude than that exhibited by the release segment bearing protease-untreated ProTIA and the protease-treated ProTIA.

Example 22: Performance of Anti-EpCAM×Anti-CD3 Protease Triggered Immune Activator (ProTIA) Composition in Human Malignant Ascites Samples Human malignant ascites are collected from patients with primary intraperitoneal EpCAM positive epithelial malignancies which includes but not limited to advanced, relapsed and refractory ovarian (adenocarcinoma and mucinous), colorectal, gastric, bile duct/cholangiocarcinoma, Ampulla of Vater, pancreatic and non-clear renal cell carcinoma patients. Patients who are receiving chemotherapy, immunological therapy, biologics and/or corticosteroid therapy within the last 30 days prior to sample collection are excluded. Malignant ascites are centrifuged at 300-400 g for 10 min at room temperature and the fluid and pellet component harvested. The concentration of human proteases including but not limited to MMP-9, MMP-2, matriptase and uPA are quantitated in the fluid component using commercially available ELISA kits (human MMP-9, Invitrogen cat #KHC3061 or equivalent; human MMP-2, Invitrogen cat #KHC3081 or equivalent; human matriptase, Enzo cat #ADI-900-221; and human uPA, Abcam cat #119611) following manufacturer's instructions. The rate of intact anti-EpCAM×anti-CD3 (e.g. AC1684, AC1685, AC1686, AC1693, AC1695, AC1714, and AC1715) cleavage by protease found in the ascites fluid is determined by spiking a known concentration of the ProTIA into the ascites fluid component and incubating mixture at 37° C., with an aliquot withdrawn at indicated time points of 0.5 h, 2h, 4 h, 8 h, 24 h, 48 h, 3 day, 4 day, 5 day and 7 day. The amount of intact anti-EpCAM×anti-CD3 ProTIA present at the respective time points are then analyzed on a rhEpCAM/biotinylated-anti-XTEN sandwich ELISA with the corresponding intact anti-EpCAM×anti-CD3 as standard.

Briefly, ELISA plate (Nunc Maxisorp cat #442404) is coated with 0.1 mircog/100 microL per well of rhEpCAM (R&D Systems, cat #EHH104111). After overnight incubation at 4° C., the ELISA plate is washed and blocked with 3% BSA for 1 h at room temperature. The plate is washed again followed by the appropriate addition of a dose range of intact, protease-untreated anti-EpCAM×anti-CD3 ProTIA standards, appropriate quality controls and ProTIA-spiked ascites test samples. The plate is allowed to incubate with shaking for 1 h at room temperature to allow the ProTIA standards, quality controls and test samples to bind to rhEpCAM coated on the plate. Unbound components are removed with several washes. Biotinylated anti-XTEN antibody (a proprietary antibody) is added at 0.1 microg/100 microL and the plate allowed to incubate at room temperature for 1 h. After washing away unbound biotinylated reagent, streptavidin-HRP (ThermoFisher Scientific cat #21130) is added at 1:30,000 dilution and plate incubated at room temperature for 1 h. After several washes, TMB substrate is added to each well. Once desired color intensity is reached, 0.2 N sulfuric acid is added to stop the reaction and absorbance (OD) is measured at 450 nm using a spectrophotometer. The intensity of the color is proportional to the concentration of intact ProTIA captured by the rhEpCAM/biotinylated-anti-XTEN sandwich ELISA. The concentration of intact ProTIA present in the ascites test samples is determined against the intact ProTIA standard curve using the SoftMax Pro software. The rate of decrease of intact ProTIA as detected in the rhEpCAM/biotinylated-anti-XTEN sandwich ELISA (i.e. half-life) is determined using GraphPad Prism. It is postulated that differences in Release Segments are likely to play a role in the metabolism rate among the protease-untreated ProTIAs The ascites pellet is phenotyped for EpCAM, CD3, CD4, CD8, CA125 and CD56 expression. Malignant ascites samples tested positive for EpCAM and CD3 are used for cytotoxic analysis with protease-treated and protease-untreated ProTIA. Briefly, $1 \times 10^5$ ascites cells are reconstituted with appropriate amount of ascites fluid and allowed to adhere on a 24-well plate for 24 h in triplicate. Cells are treated with dose concentrations of protease-treated and intact anti-EpCAM×anti-CD3 ProTIA for 48 h, followed by quantitation of caspase 3/7 using a luminogenic caspase 3/7 substrate as instructed by manufacturer (Promega Caspase-Glo 3/7 cat #G8091). With luminescence signal being proportional to caspase-3/7 activity, dose concentration of protease-treated and untreated anti-EpCAM×anti-CD3 ProTIA is then plotted against luminescence signal and the concentration of protein that give half maximal response ($EC_{50}$) is derived with a 4-parameter logistic regression equation using GraphPad prism software. It is expected that the human malignant ascites derived from advanced, relapsed and refractory EpCAM positive cancer patients will contain all necessary components for the cleavage and subsequent activation of intact anti-EpCAM×anti-CD3 ProTIA to the unXTENylated anti-EpCAM×anti-CD3 moiety that exert strong cytotoxic activity. A decrease in number of EpCAM positive cells as a sign of tumor elimination; and an increase in T cell activation markers such as CD69 and granzymes as reflective of T cell activation are also expected, Example 23: Caspase 3/7 Assay of Anti-EpCAM×Anti-CD3 Protease Triggered Immune Activator (ProTIA) Composition Redirected cellular cytotoxicity of anti-EpCAM×anti-CD3 ProTIA compositions was also assessed via caspase 3/7 activities of apoptotic cells. Similar to the LDH cytotoxicity assay described above, PBMC or purified CD3 positive T cells were mixed with EpCAM positive tumor target cells such as SW480, SK-OV-3 and OVAR-3 cells in a ratio of 5 effectors to 1 target, HCT-116 at a ratio of 10:1; and all three ProTIA versions were tested as a 12-point, 5× serial dilution dose concentrations as in the LDH assay described above.

Upon cell lysis, released caspase 3/7 in culture supernatants was measured by the amount of luminogenic caspase 3/7 substrate cleavage by caspase 3/7 to generate the "glow-type" luminescent signal (Promega Caspase-Glo 3/7 cat #G8091). The amount of luminescence is proportional to the amount of caspase activities.

Figure 57:
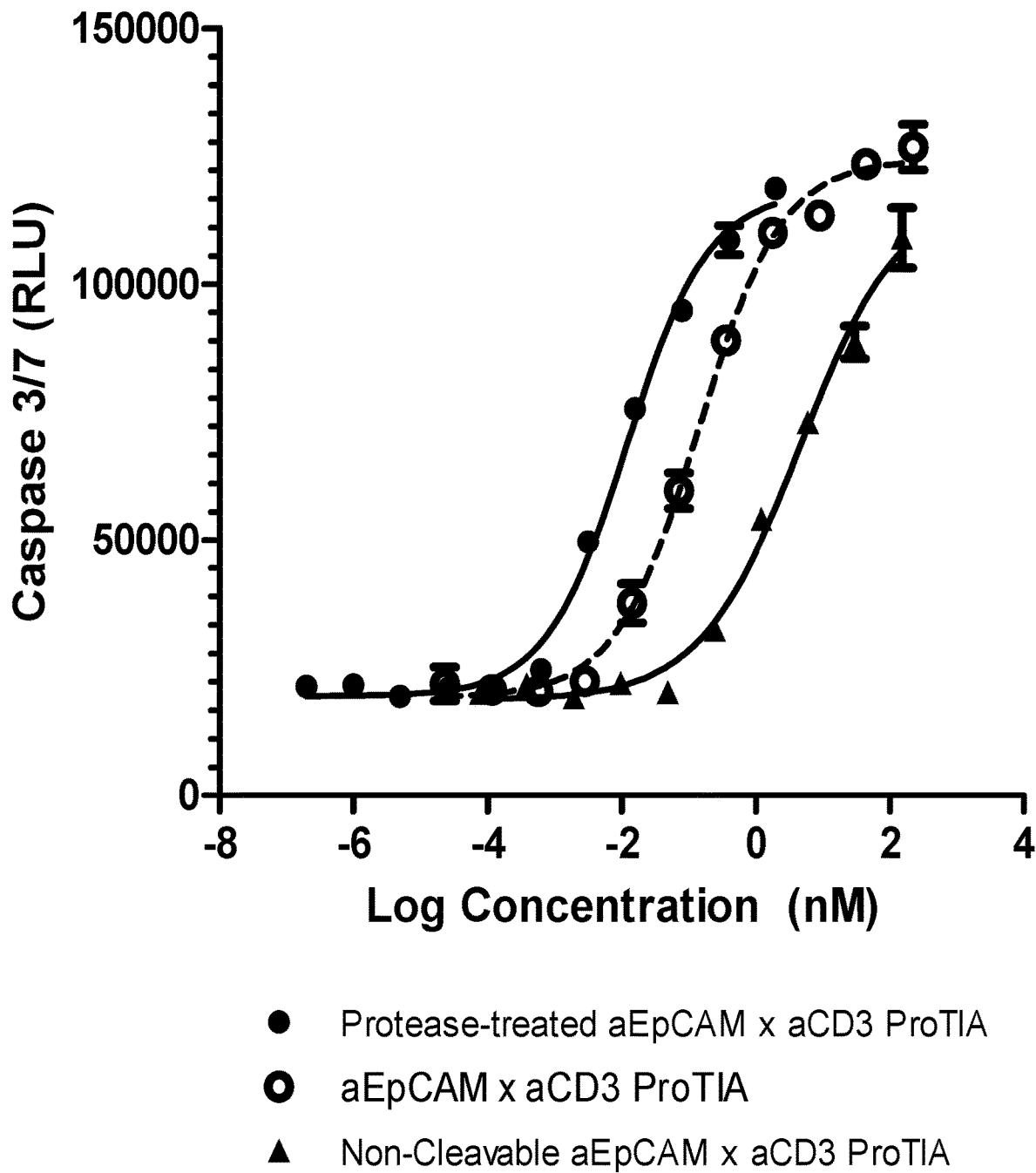
FIG. 57 depicts results from the experiment to determine the in vitro activity of protease-treated, protease-untreated and protease-noncleavable antiEpCAM×antiCD3 ProTIA in SKOV3 with human PBMC as described in Example 23.
Figure 58:
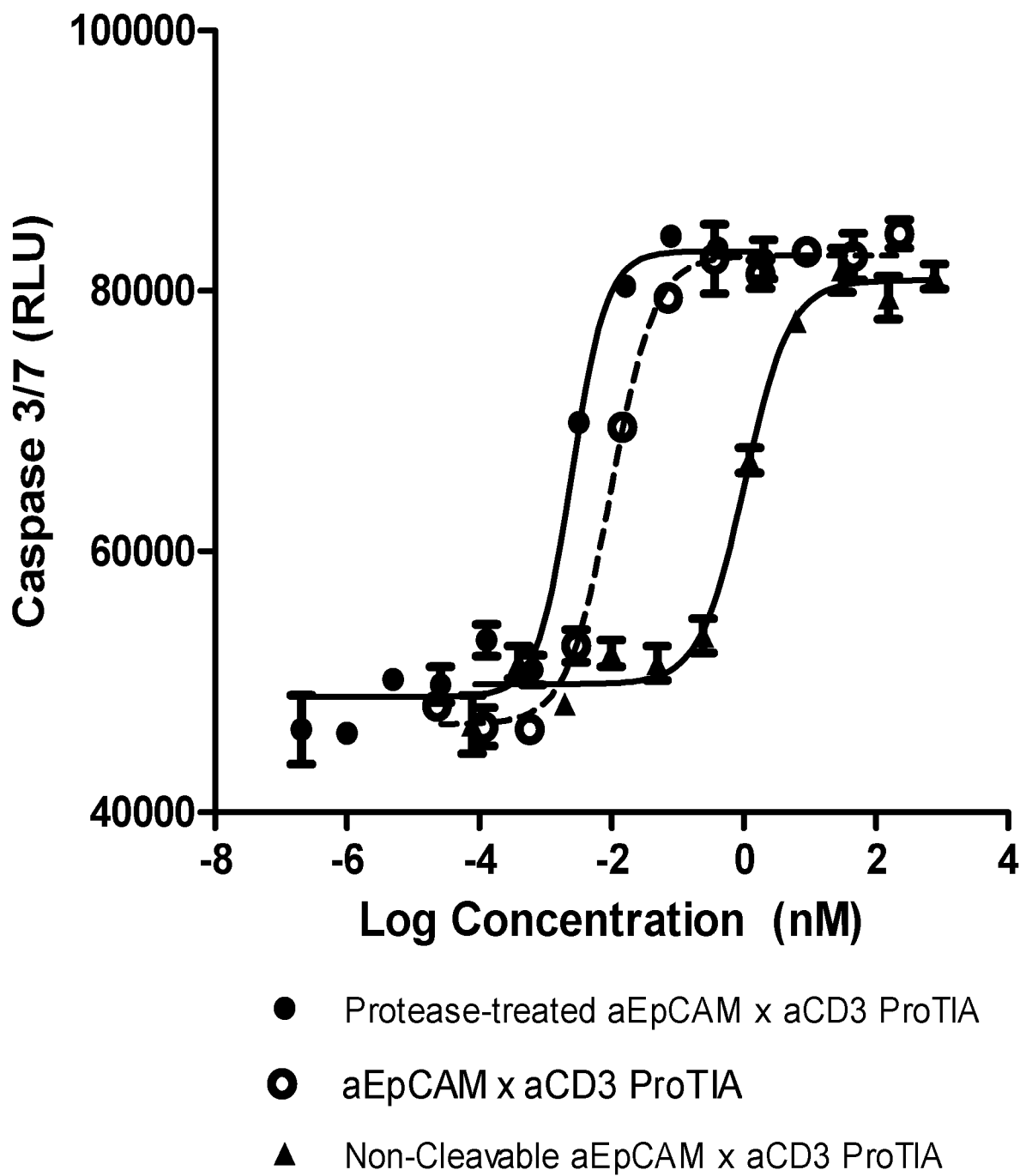
FIG. 58 depicts results from the experiment to determine the in vitro activity of protease-treated, protease-untreated and protease-noncleavable antiEpCAM×antiCD3 ProTIA in OVCAR3 with human PBMC as described in Example 23.
Figure 59:
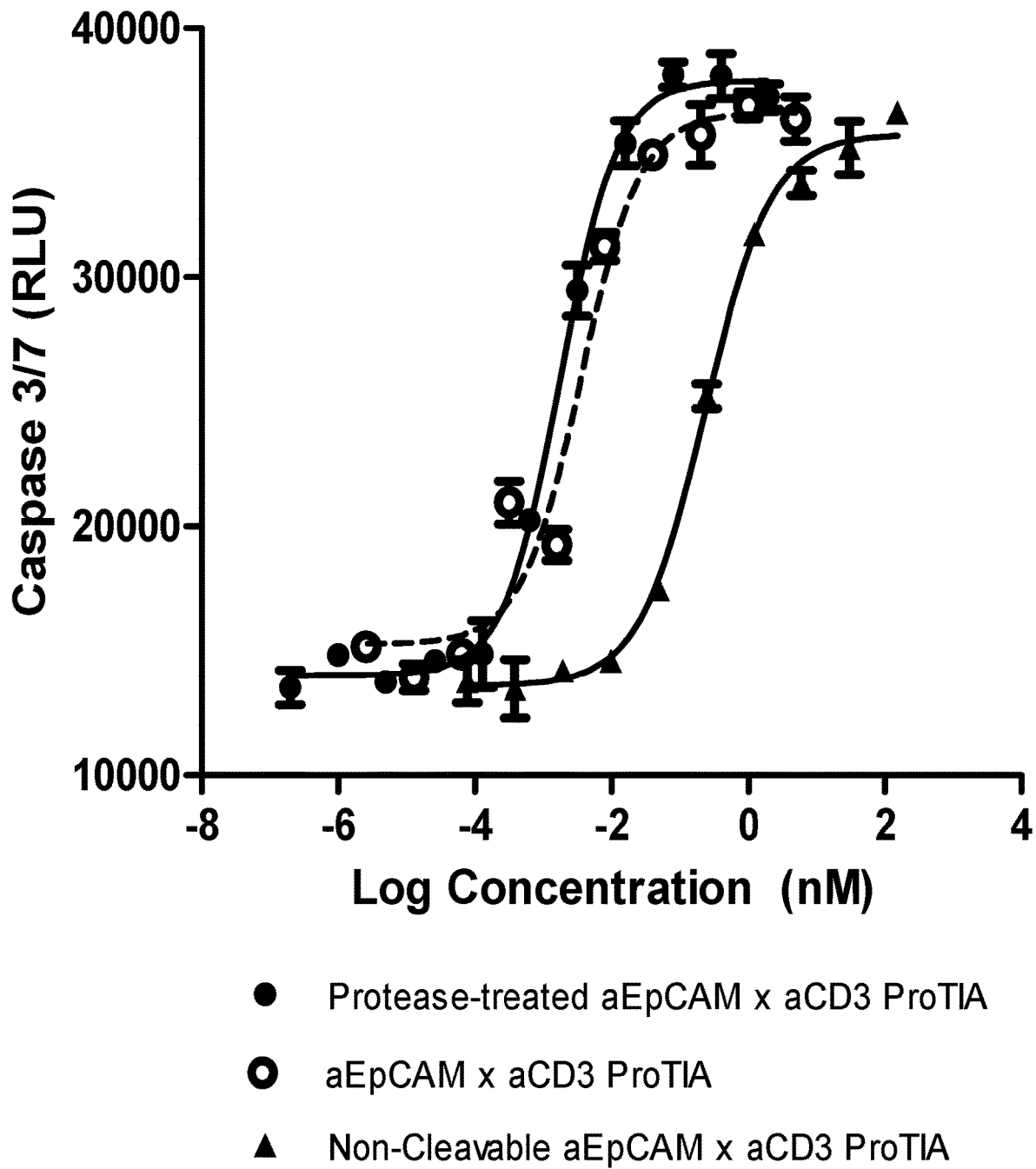
FIG. 59 depicts results from the experiment to determine the in vitro activity of protease-treated, protease-untreated and protease-noncleavable antiEpCAM×antiCD3 ProTIA in HCT116 with human PBMC as described in Example 23.
Figure 60:
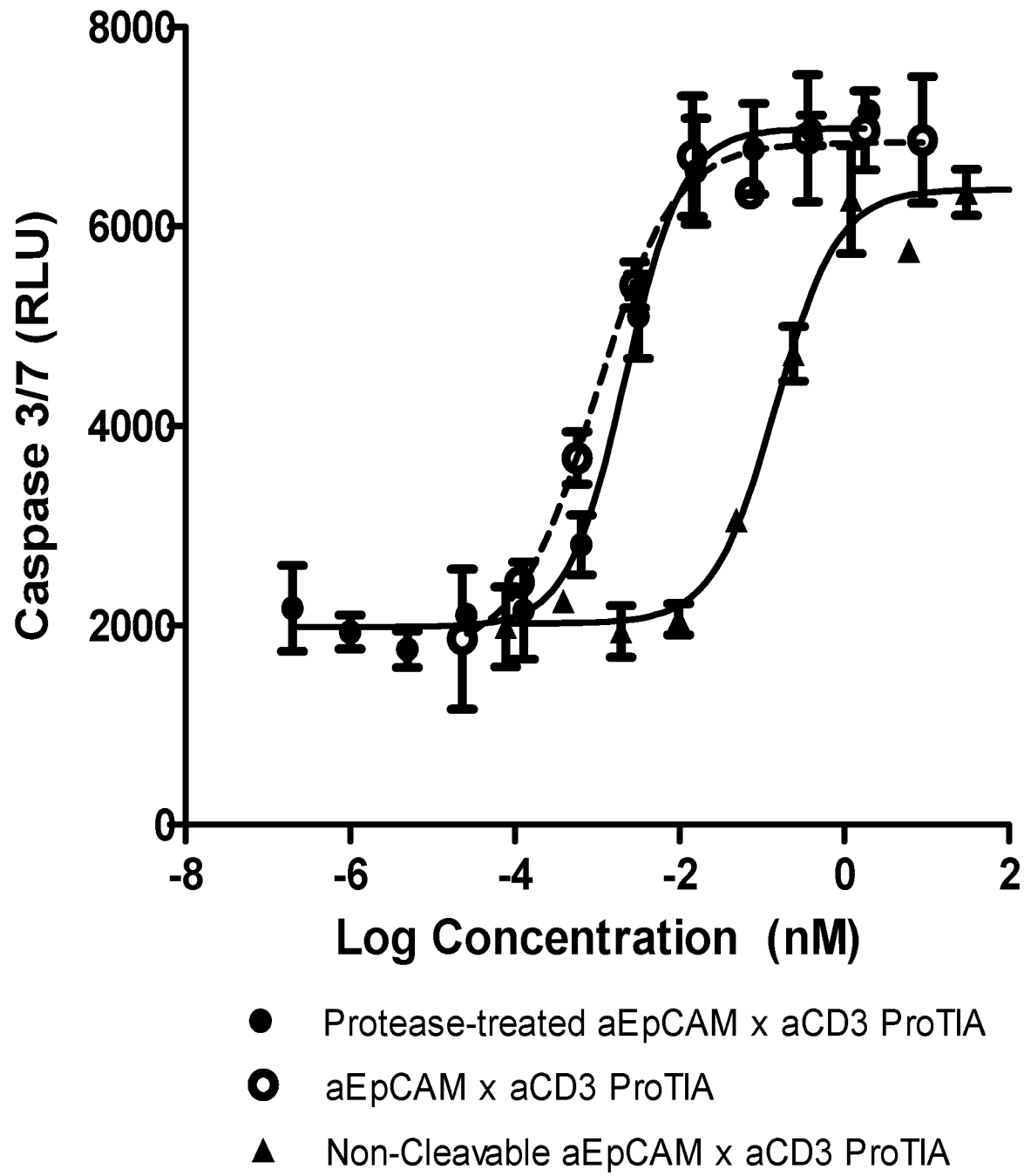
FIG. 60 depicts results from the experiment to determine the in vitro activity of protease-treated, protease-untreated and protease-noncleavable antiEpCAM×antiCD3 ProTIA in SW480 with human PBMC as described in Example 23.

As expected, the activity trend of the protease-treated, protease-untreated and non-cleavable anti-EpCAM×anti-CD3 ProTIA profiled in SK-OV-3, OVCAR-3, HCT-116 and SW480 tumor cell lines was found to be in agreement with the activities observed in the LDH assay analysis. In the cytotoxic killing of SK-OV-3 ovarian cells by human PBMC, untreated anti-EpCAM×anti-CD3 ProTIA is 12-fold less active than protease-treated ProTIA ($EC_{50}$ of 140 pM vs. 12 pM); and the non-cleavable anti-EpCAM×anti-CD3 ProTIA is 390-fold less active than the protease-cleaved ProTIA ($EC_{50}$ of 4700 pM vs. 12 pM) (FIG. 57). In the cytotoxic killing of OVCAR-3 ovarian cells by PBMC, protease-uncleaved anti-EpCAM×anti-CD3 ProTIA is 4-fold less active than protease-treated ProTIA ($EC_{50}$ of 9.8 pM vs. 2.5 pM); and the non-cleavable anti-EpCAM×anti-CD3 ProTIA is 420-fold less active than the protease-cleaved ProTIA ($EC_{50}$ of 1043 pM vs. 2.5 pM) (FIG. 58). In the cytotoxic killing of HCT-116 colorectal cells by PBMC, protease-treated and intact protease-untreated anti-EpCAM×anti-CD3 ProTIA have almost similar activity ($EC_{50}$ of 1.8 pM vs. 3.6 pM); and the non-cleavable anti-EpCAM×anti-CD3 ProTIA is 130-fold less active than the protease-cleaved ProTIA ($EC_{50}$ of 240 pM vs. 1.8 pM) (FIG. 59). In the cytotoxic killing of SW480 colorectal cells by PBMC, protease-treated and protease-uncleaved anti-EpCAM×anti-CD3 ProTIA also demonstrated similar activity ($EC_{50}$ of 2 pM vs. 1 pM); and the non-cleavable anti-EpCAM×anti-CD3 ProTIA is 70-fold less active than the protease-cleaved ProTIA ($EC_{50}$ of 148 pM vs. 2 pM) (FIG. 60). Results demonstrated that non-cleavable ProTIA is consistently less active than the unXTENylated anti-EpCAM×anti-CD3 moiety. Depending on cell lines used, the activity of intact, protease-untreated ProTIA ranged from similar to 12-fold less active as compared to protease-cleaved ProTIA, suggesting a difference in degree of susceptibility of the release segment to proteases postulated to be released from the tumor cells and/or activated CD3 positive T cells in the assay mixture.

Example 24: Proteolytic Cleavage of AC1476 aEpCAM-aCD3-BSRS1-XTEN_AE864-His(6) Using Various Proteases The experiment was conducted to demonstrate that the aEpCAM-aCD3-BSRS1-XTEN_AE864-His(6) AC1476, previously described in Example 3, can be cleaved in vitro by multiple tumor-associated proteases, including MMP-2, MMP-9, and neutrophil elastase.

1. Enzyme Activation

All enzymes used were obtained from R&D Systems. Recombinant neutrophil elastase and recombinant human matriptase were provided as activated enzymes and stored at −80° C. until use. Recombinant mouse MMP-2 and recombinant mouse MMP-9 were supplied as zymogens and required activation by 4-aminophenylmercuric acetate (APMA). APMA was first dissolved in 0.1M NaOH to a final concentration of 10 mM before the pH was readjusted to neutral using 0.1N HCl. Further dilution of the APMA stock to 2.5 mM was done in 50 mM Tris, 150 mM NaCl, 10 mM $CaCl_2$), pH 7.5. To activate pro-MMP, 1 mM APMA and 100 µg/mL of pro-MMP were incubated at 37° C. for 1 hour (MMP-2) or 3 hours (MMP-9). Glycerol was added to activated enzymes to a final concentration of 50% and then each was stored at −20° C.

2. Enzymatic Digestion

A panel of enzymes was used to digest the AC1476 aEpCAM-aCD3-BSRS1-XTEN_AE864-His(6) ProTIA composition. 10 µM of the substrate composition was incubated individually with each enzyme in the following enzyme-to-substrate molar ratios: MMP-2 (1:200), MMP-9 (1:2000), matriptase (1:12.5), and neutrophil elastase (1:1000). Reactions were incubated at 37° C. for two hours before stopping digestion by gel loading dye and heating at 80° C.

3. Analysis of Cleavage.

Analysis of the samples was performed by loading 5 µg of undigested and digested material on SDS-PAGE and staining with Coomassie Blue. Upon treatment by each protease at the BSRS-1 release segment, the substrate yielded two fragments detectable in the SDS-PAGE gel, with the small fragment containing aEpCAM-aCD3 (the activated first portion form with the binding domains) and the other containing released XTEN, which migrates at a slightly lower apparent molecular weight on SDS-PAGE than the intact form. For neutrophil elastase, which also digests released XTEN, the activated form was observed in the gel as well as other smaller fragments; the latter due to the cleavage of XTEN at various locations along the sequence. The results confirm that all proteases tested cleaved the construct as intended, with the release of the binding domains.

Example 25: Anti-Tumor Properties of Anti-EpCAM×Anti-CD3 Protease Triggered Immune Activator (ProTIA) Composition in Established Colorectal Tumor Model In the established colorectal tumor model, HCT-116 tumor cells were independently implanted into NOG (NOD/Shi-scid/IL-2Rg$^{null}$) mice on day 0. (The NOG mice are NOD/SCID mice bearing IL-2Rg mutation resulting in the mice lacking T, B and NK cells, dysfunctional macrophage, dysfunctional dendritic cells and reduced complement activity.) Human PBMC were then intravenously introduced on day 4. When the HCT-116 tumor had reached a volume of 100-150 mm$^3$, treatment with anti-EpCAM×anti-CD3 Pro-TIAs were initiated 3×per week for 4 weeks at equimolar concentration of 21.6 nmol/kg. This is equivalent to 1.26 mg/kg of protease-cleaved and 3.0 mg/kg of protease-untreated and non-cleavable anti-EpCAM×anti-CD3 Pro-TIA.

Figure 61:
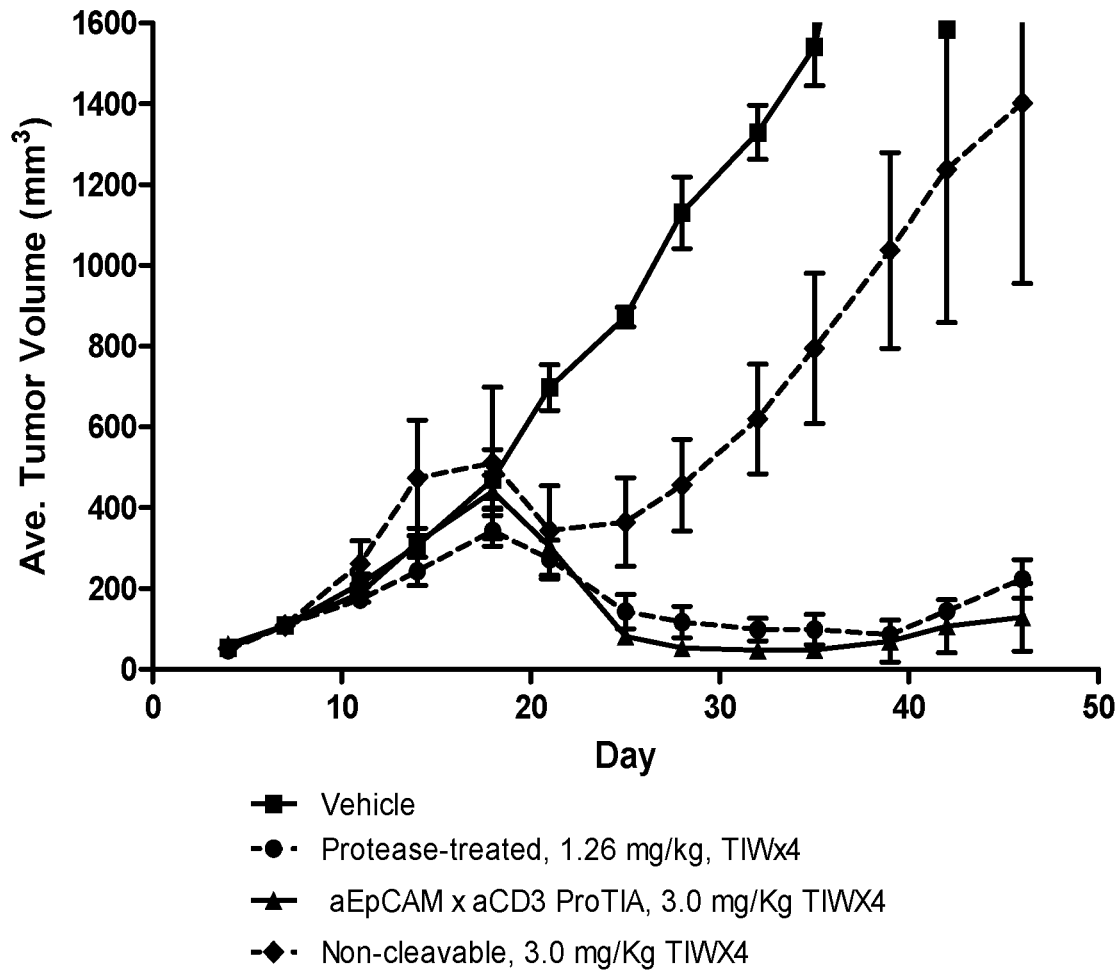
FIG. 61 depicts HCT-116 tumor volume results from experiment to determine the antitumor effect of protease-treated, protease-untreated, and non-cleavable anti-EpCAM×anti-CD3 ProTIAs, as described in Example 25

Both protease-cleaved and protease-untreated ProTIA (e.g. AC1476) led to significant reduction of established HCT-116 tumors when compared to vehicle-treated control group (p=0.004 and p=0.001 respectively). The non-cleavable anti-EpCAM×anti-CD3 ProTIA (e.g. AC1484) did not retard tumor growth as expected since it does not contain the substrate sequence for protease cleavage within the tumor environment (p=0.198) (FIG. 61).

Example 26: Anti-Tumor Properties of Anti-EpCAM×Anti-CD3 Protease Triggered Immune Activator (ProTIA) Composition in OVCAR-3 Ovarian Model The in vivo efficacy of anti-EpCAM×anti-CD3 ProTIA was also evaluated using the human platinum-resistant OVCAR-3 ovarian cell line implanted intraperitoneally into the severely immunodeficient NOG (NOD/Shi-scid/IL-2Rg$^{null}$) mice. NOG mice are characterized by the deficiency of T, B and NK cells, as well as the dysfunction of macrophages, dendritic cell and complement system. On day 0, eight cohorts (Groups 1-7 with 6 NOG mice per group; and Group 9 with 8 NOG mice) were implanted intraperitoneally with 10×10$^6$ OVCAR-3 cells. Group 8, comprising of 5 NOG mice, was also set up on day 0 with no OVCAR-3 inoculation. When tumor cells were observed to have progressed as reflected by an increase in human CA125 level from baseline (below limit of detection) to 300-400 U/mL on day 20, 10×10$^6$ of PBMC were intraperitoneally introduced to Groups 1-8. Group 9 did not received any PBMC. Treatments were initiated on day of PBMC inoculation with Groups 1, 8 and 9 injected with vehicle (PBS+0.05% Tween 80), Group 2 with 0.21 mg/kg protease-treated anti-EpCAM×anti-CD3 ProTIA, Group 3 with 1.05 mg/kg protease-treated anti-EpCAM×anti-CD3 ProTIA, Group 4 with 0.5 mg/kg with protease-untreated anti-EpCAM×anti-CD3 ProTIA, Group 5 with 2.5 mg/kg with protease-untreated anti-EpCAM×anti-CD3 ProTIA, Group 6 with 0.49 mg/kg non-cleavable anti-EpCAM×anti-CD3 ProTIA, and Group 7 with 2.46 mg/kg non-cleavable anti-EpCAM×anti-CD3 ProTIA. All cohorts were treated twice per week for 4 weeks. Mice were monitored daily for behavior and survival, and twice weekly for body weight and abdomen distention. Blood were collected on day 28, day 42 and day 48 for CA125 determination as sign of tumor development.

Figure 62:
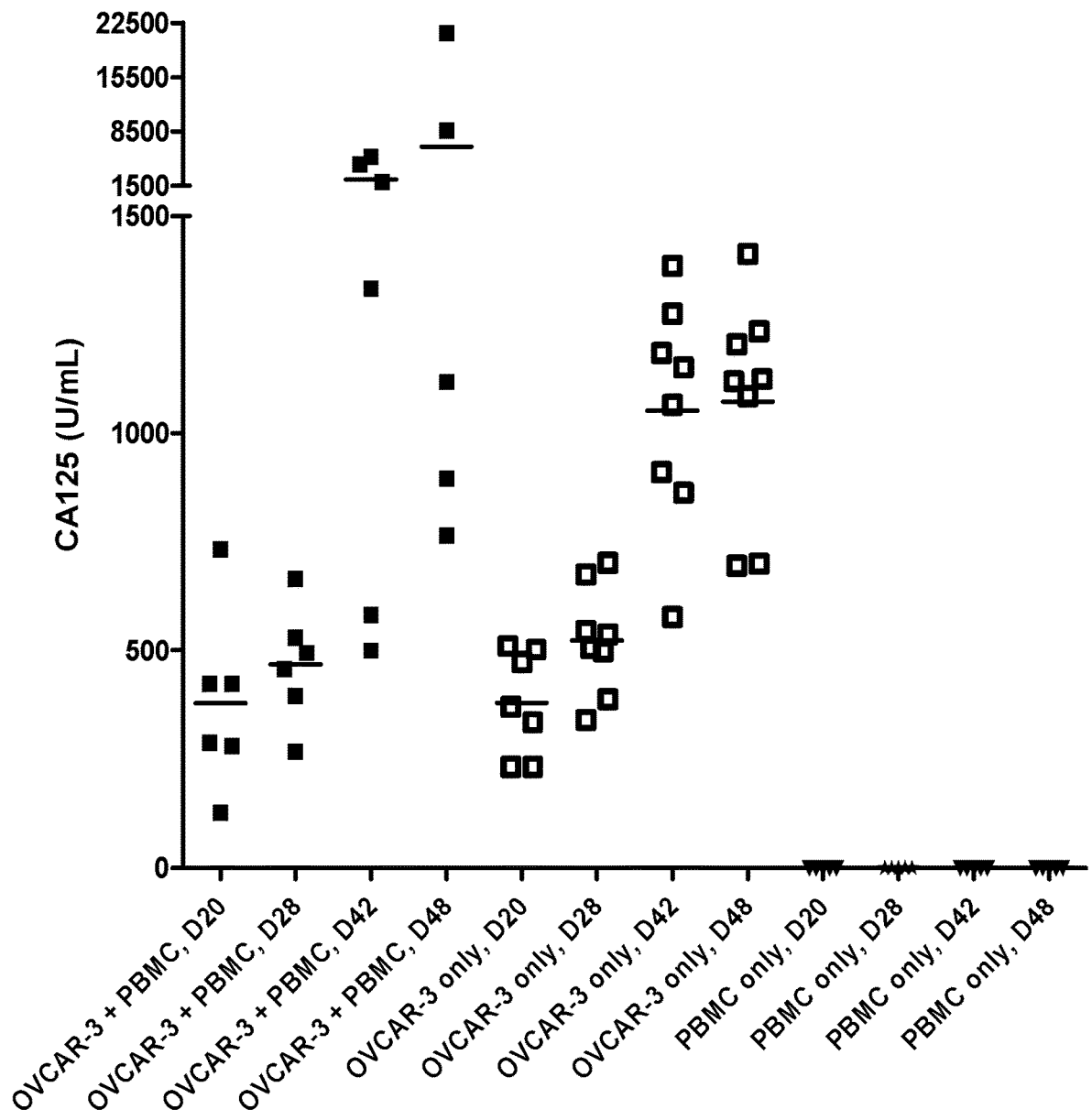
FIG. 62 depicts human CA125 levels in control Group 1 bearing OVCAR-3 and PBMC, Group 8 bearing PBMC only and Group 9 bearing OVCAR-3 only, as described in Example 26.

Growth of OVCAR-3 tumor was most clearly evidenced by an increase in circulating human CA125 levels. As shown in FIG. 62, CA125 level in Group 1 (OVCAR3+PBMC) increased from 378±187 U/mL on day 20 to 6506±7911 U/mL on day 48; and in Group 9 (OVCAR-3 only) from 379±111 U/mL on day 20 to 1072±236 U/mL on day 48. Group 8 bearing only PBMC only with no OVCAR-3 cells had below limit of detection CA125 level throughout the study.

Figure 63:
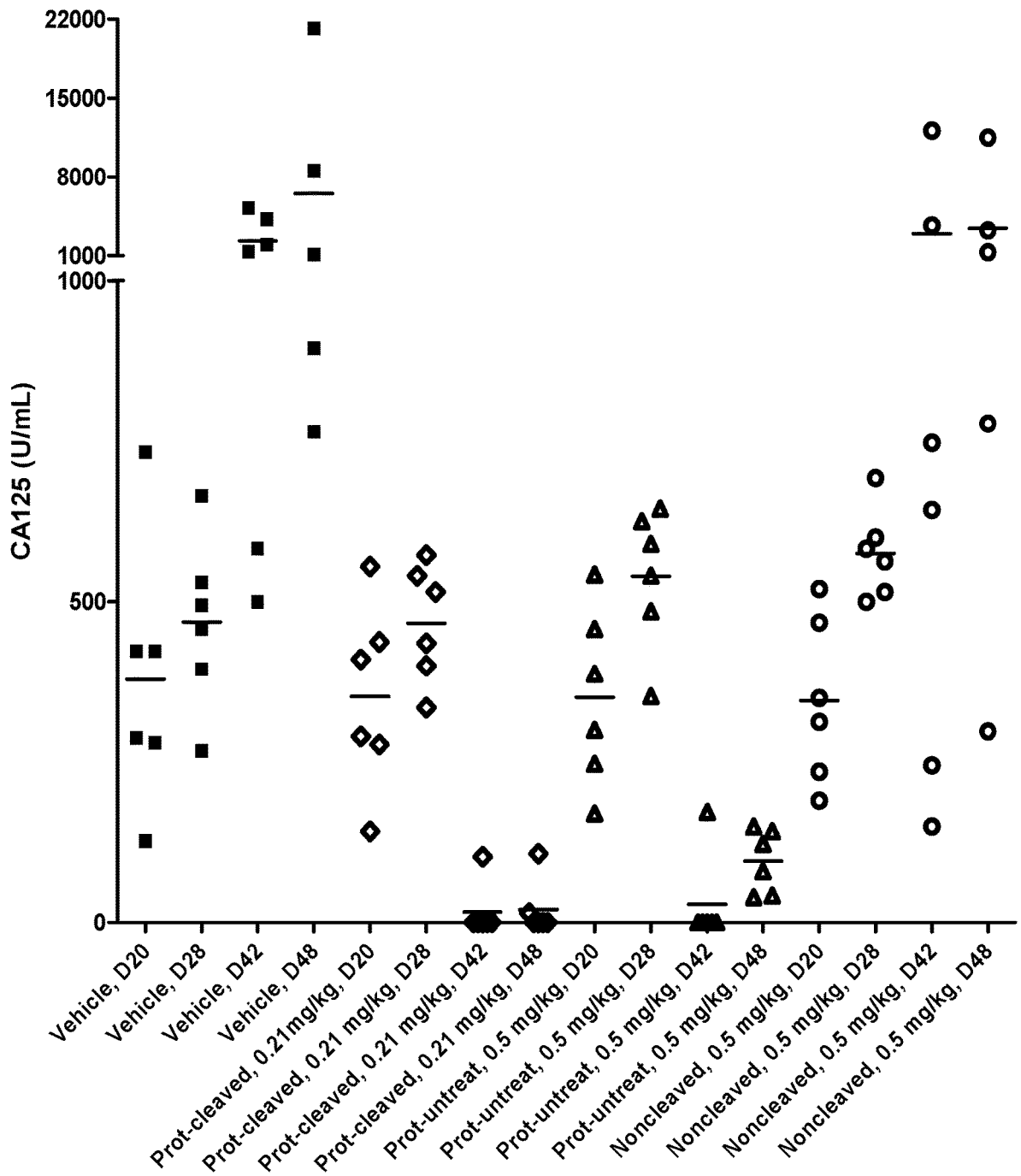
FIG. 63 depicts human CA125 levels from experiment to determine the antitumor effect of low dose protease-treated anti-EpCAM×anti-CD3 ProTIA (Group 2), protease-untreated anti-EpCAM×anti-CD3 ProTIA (Group 4), and non-cleavable anti-EpCAM×anti-CD3 ProTIA (Group 6), as described in Example 26.
Figure 64:
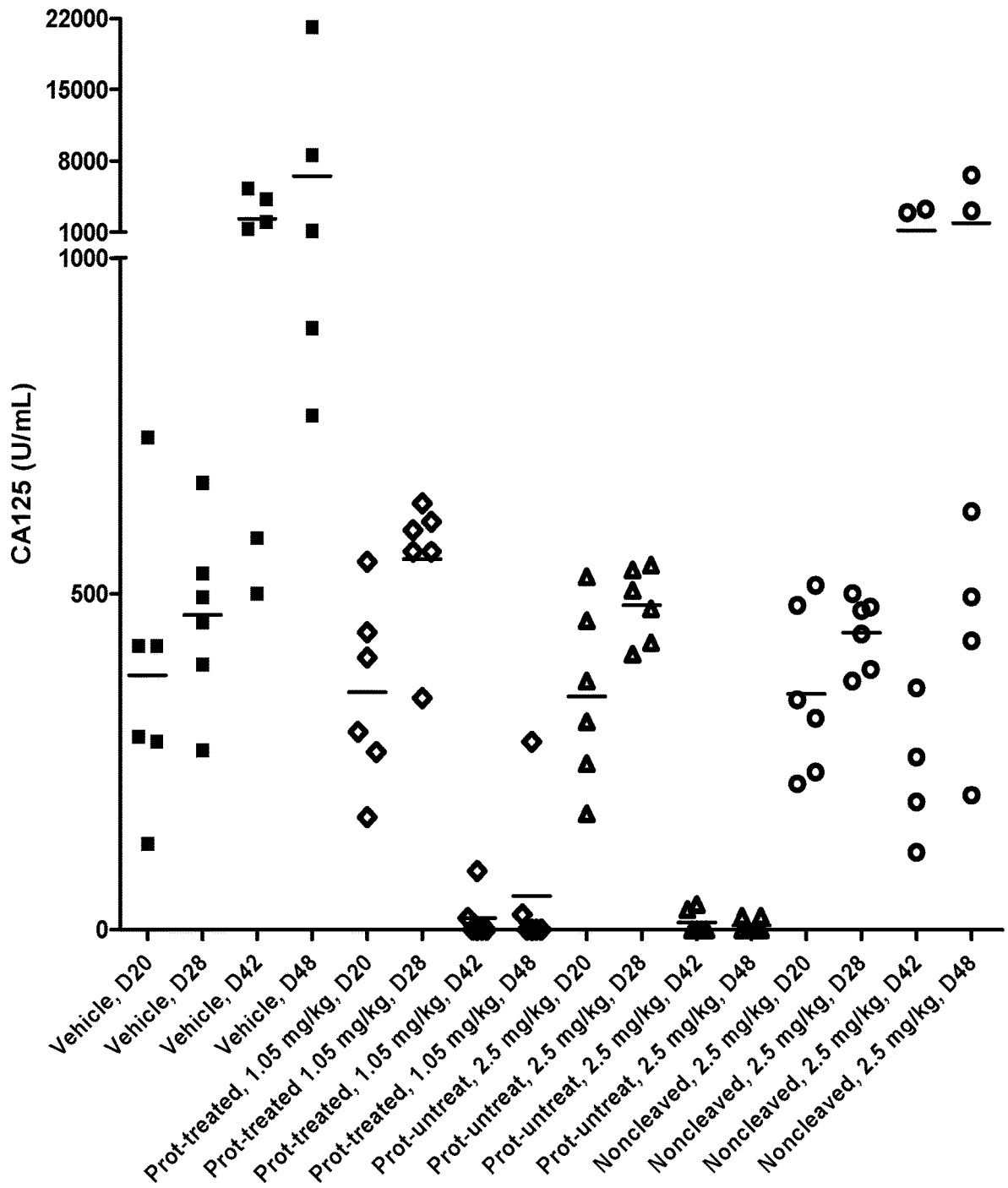
FIG. 64 depicts human CA125 levels from experiment to determine the antitumor effect of high dose protease-treated anti-EpCAM×anti-CD3 ProTIA (Group 3), protease-untreated anti-EpCAM×anti-CD3 ProTIA (Group 5), and non-cleavable anti-EpCAM×anti-CD3 ProTIA (Group 7), as described in Example 26.

As expected both protease-cleaved and protease-untreated anti-EpCAM×anti-CD3 ProTIA (e.g. AC1476) led to decrease level of circulating CA125 over time. This was demonstrated for both dose levels. As shown in FIG. 63 (low dose) and FIG. 64 (high dose), CA125 level in Group 2 (0.21 mg/kg protease-treated anti-EpCAM×anti-CD3 ProTIA) decreased from 352±132 U/mL on day 20 to 20.4±39 U/mL on day 48; Group 3 (1.05 mg/kg protease-treated anti-EpCAM×anti-CD3 ProTIA) decreased from 354±125 U/mL on day 20 to 50±103 U/mL on day 48; Group 4 (0.5 mg/kg protease-untreated anti-EpCAM×anti-CD3 ProTIA) decreased from 351±126 U/mL on day 20 to 96±45 U/mL on day 48; and Group 5 (2.5 mg/kg protease-untreated anti-EpCAM×anti-CD3 ProTIA) decreased from 348±120 U/mL on day 20 to 7±10 U/mL on day 48.

The non-cleavable anti-EpCAM×anti-CD3 ProTIA treated groups demonstrated an increased in CA125 levels over time. Group 6 (0.49 mg/kg non-cleavable anti-EpCAM×anti-CD3 ProTIA) saw an increased in CA125 from 344±118 U/mL on day 20 to 3426±4170 U/mL on day 48; and Group 7 (2.46 mg/kg non-cleavable anti-EpCAM×anti-CD3 ProTIA) demonstrated an increased in CA125 from 351±113 U/mL on day 20 to 1905±2534 U/mL on day 48.

Example 27: Anti-Tumor Properties of Anti-EpCAM×Anti-CD3 Protease Triggered Immune Activator (ProTIA) Composition in OVCAR-3 Ovarian Model Versus Standard of Care The in vivo efficacy of protease-untreated anti-EpCAM×anti-CD3 ProTIA (such that the ProTIA remained intact) administered intraperitoneal versus intravenous as well as against bevacizumab was evaluated using the human platinum-resistant OVCAR-3 ovarian cell line implanted intraperitoneally into the severely immunodeficient NOG (NOD/Shi-scid/IL-2Rg$^{null}$) mice. NOG mice are characterized by the deficiency of T, B and NK cells, as well as the dysfunction of macrophages, dendritic cell and complement system. On day 0, eight cohorts (Groups 1-7 and Group 9) of 6 NOG mice per group were implanted intraperitoneally with $10 \times 10^6$ OVCAR-3 cells. Group 8, comprising of 6 NOG mice, was also set up on day 0 with no OVCAR-3 inoculation. When tumor cells were observed to have progressed as reflected by an increase in human CA125 level from baseline (below limit of detection) to approximately 650 U/mL on day 21, $10 \times 10^6$ of PBMC were intravenously introduced to Groups 1-8. Group 9 did not received any PBMC. Treatments were initiated on day of PBMC inoculation with Groups 1, 8 and 9 intravenously injected with vehicle (PBS+0.05% Tween 80), Group 2 intraperitoneally administered with 0.5 mg/kg protease-untreated anti-EpCAM×anti-CD3 ProTIA, Group 3 intraperitoneally administered with 2.5 mg/kg protease-untreated anti-EpCAM×anti-CD3 ProTIA, Group 4 intravenously administered with 0.5 mg/kg with protease-untreated anti-EpCAM×anti-CD3 ProTIA, Group 5 intravenously administered with 2.5 mg/kg protease-untreated anti-EpCAM×anti-CD3 ProTIA, Group 6 intravenously administered with 2 mg/kg bevacizumab, and Group 7 intravenously administered with 5 mg/kg bevacizumab. All cohorts were treated twice per week for 4 weeks. Mice were monitored daily for behavior and survival, and twice weekly for body weight and abdomen distention. Blood were collected on day 27, day 34, day 41, day 48 and at sacrifice for CA125 determination as sign of tumor development.

Growth of OVCAR-3 tumor was most clearly evidenced by an increase in circulating human CA125 levels. CA125 level in Group 1 (OVCAR3+PBMC) increased from 682±259 U/mL on day 21 to 1727±749 U/mL at sacrifice; and in Group 9 (OVCAR-3 only) from 671±212 U/mL on day 21 to 3554±2908 U/mL at sacrifice. Group 8 bearing only PBMC only with no OVCAR-3 cells had below limit of detection CA125 level throughout the study.

Figure 65:
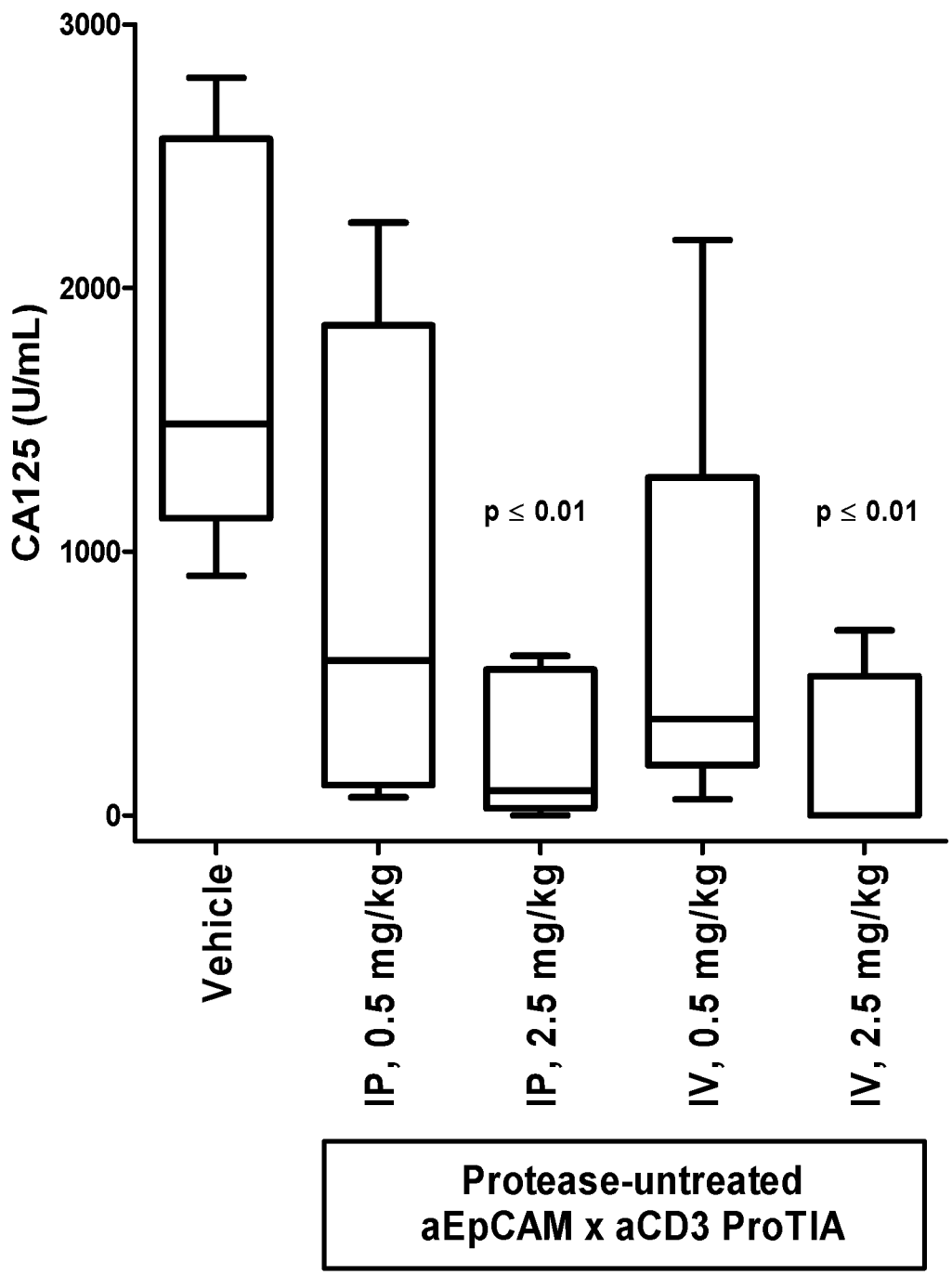
FIG. 65 depicts human CA125 levels from experiment to determine the antitumor effect of protease-untreated anti-EpCAM×anti-CD3 ProTIA administered intraperitoneally versus intravenously in mice bearing OVCAR-3 tumor, as described in Example 27.

As monitored by CA125, protease-untreated anti-EpCAM×anti-CD3 ProTIA (e.g. AC1476) administered intravenously was as efficacious was intraperitoneal administration (FIG. 65). CA125 level in Group 2 (0.5 mg/kg protease-untreated anti-EpCAM×anti-CD3 ProTIA, IP) increased slightly from 679±242 U/mL on day 21 to 891±897 U/mL at sacrifice; Group 3 (2.5 mg/kg protease-untreated anti-EpCAM×anti-CD3 ProTIA, IP) decreased from 677±241 U/mL on day 21 to 228±269 U/mL at sacrifice; Group 4 (0.5 mg/kg protease-untreated anti-EpCAM×anti-CD3 ProTIA, IV) remained relatively unchanged from 661±216 U/mL on day 21 to 661±861 U/mL at sacrifice; and Group 5 (2.5 mg/kg protease-untreated anti-EpCAM×anti-CD3 ProTIA, IV) decreased from 658±200 U/mL on day 21 to 180±348 U/mL at sacrifice.

Figure 66:
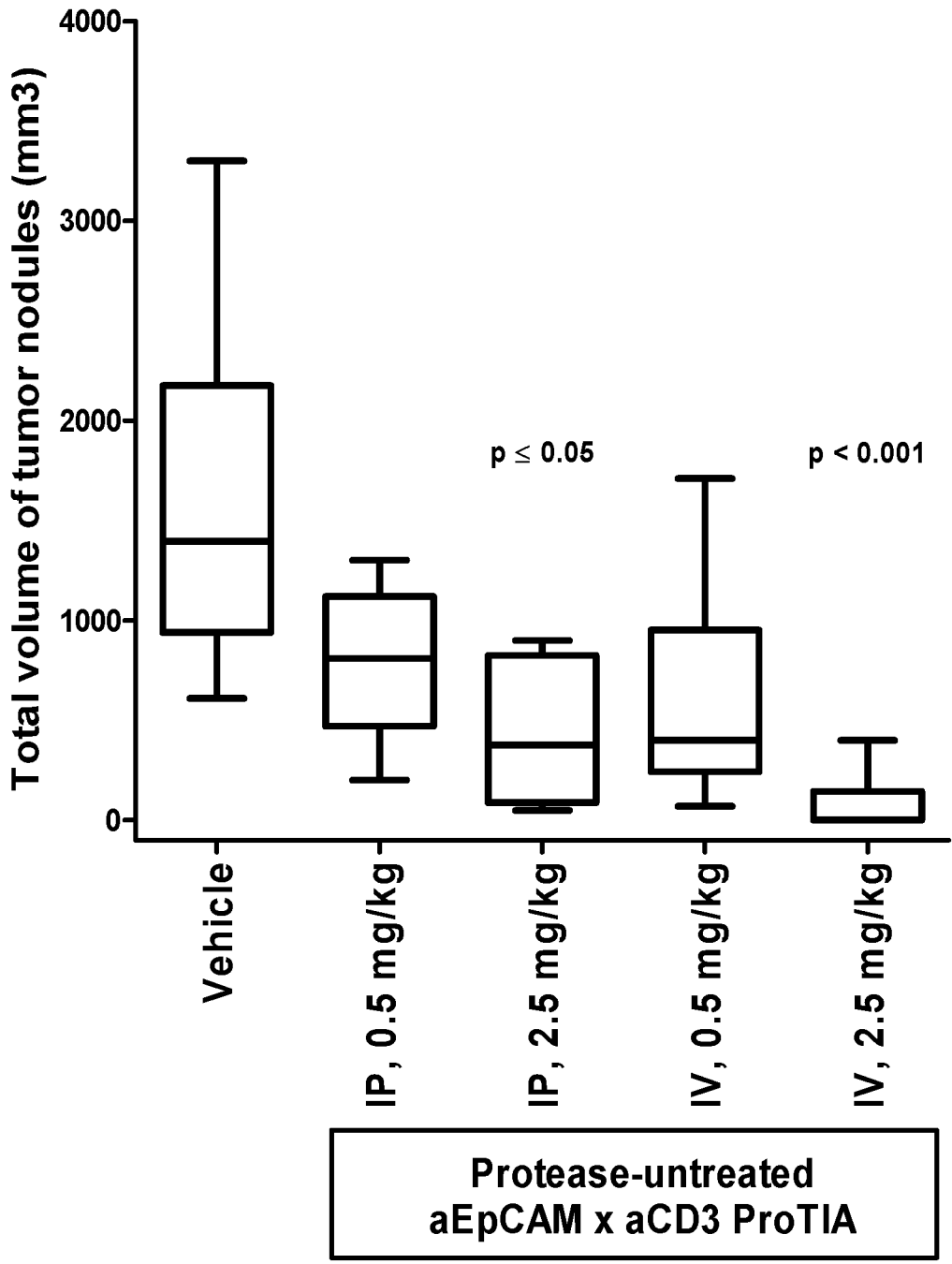
FIG. 66 depicts total tumor volume from experiment to determine the antitumor effect of protease-untreated anti-EpCAM×anti-CD3 ProTIA administered intraperitoneally versus intravenously in mice bearing OVCAR-3 tumor, as described in Example 27.

When monitored by total tumor volume at sacrifice of all animals, intravenous administered protease-untreated anti-EpCAM×anti-CD3 ProTIA out-performed administration via intraperitoneal route especially between the higher dose groups. Total tumor volume for all animals at sacrifice for Group 3 (2.5 mg/kg protease-untreated anti-EpCAM×anti-CD3 ProTIA, IP) was 2600 mm$^3$; and was 460 mm$^3$ for Group 5 (2.5 mg/kg protease-untreated anti-EpCAM×anti-CD3 ProTIA, IV) (FIG. 66).

Figure 67:
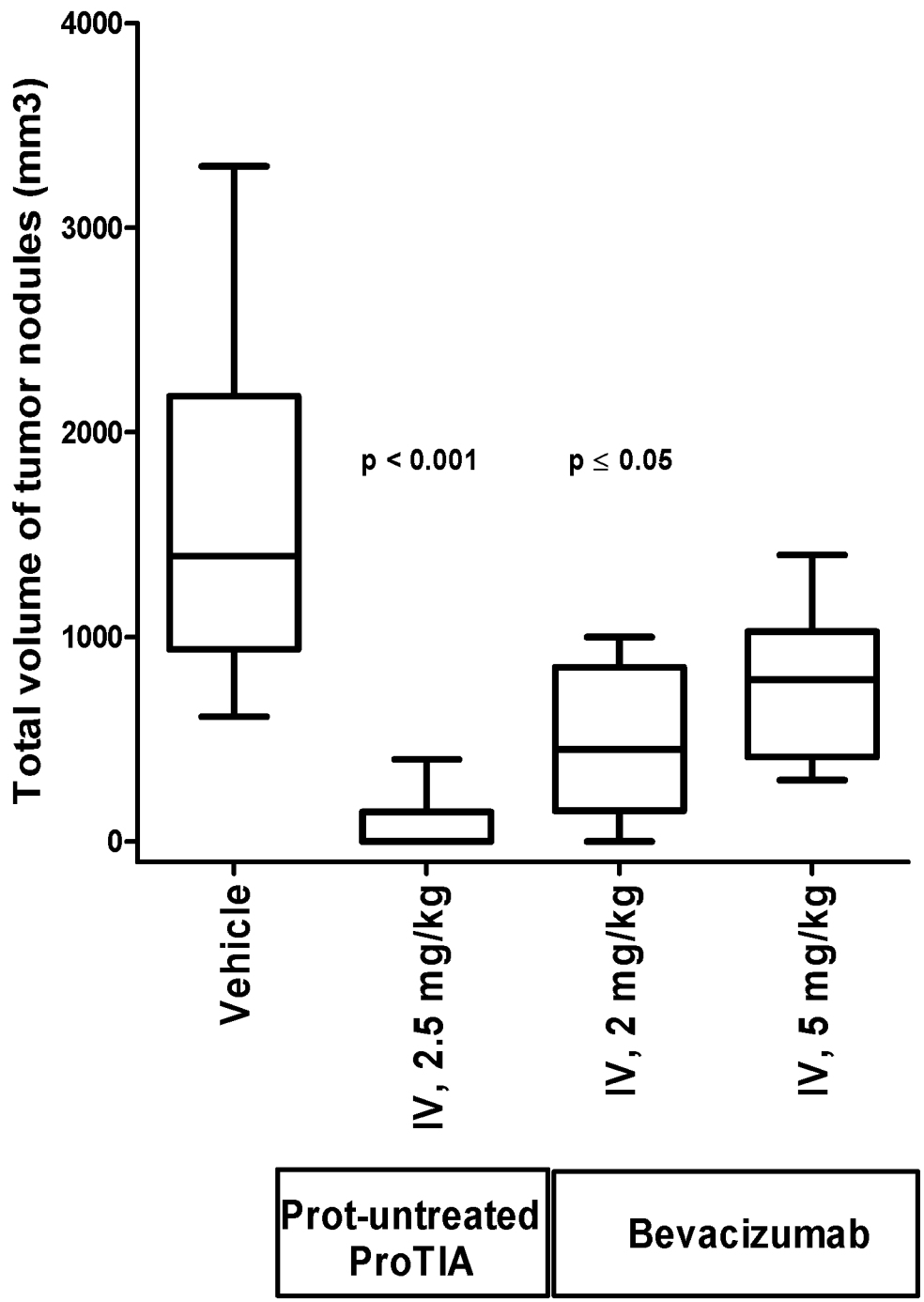
FIG. 67 depicts total tumor volume from experiment to determine the antitumor effect of protease-untreated anti-EpCAM×anti-CD3 ProTIA versus bevacizumab in mice bearing OVCAR-3 tumor, as described in Example 27.

When monitored by total tumor volume at sacrifice of all animals, intravenous administered 2.5 mg/kg protease-untreated anti-EpCAM×anti-CD3 ProTIA (Group 5) out-performed 2 mg/kg and 5 mg/kg bevacizumab treated cohorts, with lower total tumor volume. Total tumor volume for all animals at sacrifice for Group 5 (2.5 mg/kg protease-untreated anti-EpCAM×anti-CD3 ProTIA, IV) was 460 mm$^3$ compared to 2900 mm3 for Group 6 (2 mg/kg bevacizumab, IV) and 4630 mm$^3$ for Group 7 (5 mg/kg bevacizumab, IV) (FIG. 67).

Example 28: CD3 Binding Assay of Anti-EpCAM×Anti-CD3 Protease Triggered Immune Activator (ProTIA) Composition The binding capability of anti-EpCAM×anti-CD3 ProTIA composition was verified with a CD3epsilon-delta/anti-XTEN sandwich ELISA. In the ELISA binding assay, recombinant human CD3 (rhCD3) (Creative Biomart cat #CD3E&CD3D-219H) was coated on a 96-well, flat-bottomed plate at a concentration of 0.25 microg/100 microL. After overnight incubation at 4° C., the assay plate was washed and blocked with 3% bovine serum albumin (BSA) for 1 h at room temperature. The plate was washed again followed by the introduction of a dose range of non-cleavable anti-EpCAM×anti-CD3 ProTIA (i.e., a ProTIA without the release segment cleavage sequence and AC1484, a ProTIA chimeric polypeptide assembly composition) and protease-untreated anti-EpCAM×anti-CD3 ProTIA (e.g. AC1684, AC1685, AC1686, AC1693, AC1695, AC1714, AC1715). The dose range utilized for non-cleavable and protease-untreated ProTIA was 3,600 to 0.077 ng/mL, achieved with a 1:6 fold serial dilution scheme from a starting concentration of 3,600 ng/mL. The plate was allowed to incubate with shaking for 1 h at room temperature to allow the non-cleavable, protease-uncleaved ProTIA to bind to the rhCD3ε & δ coated on the plate. Unbound components were removed with a wash step and a proprietary biotinylated anti-XTEN monoclonal antibody was added. After an appropriate incubation period that allowed the anti-XTEN antibody to bind to the XTEN polypeptide on the ProTIAs, any unbound reagent was removed by a wash step followed by the addition of tetramethylbenzidine (TMB) substrate to each well. TMB is a chromogenic substrate of peroxidase. After desired color intensity was reached, 0.2 N sulfuric acid was added to stop the reaction and absorbance (OD) was measured at 450 nm using a spectrophotometer. The intensity of the color is proportional to the concentration of non-cleavable, protease-untreated anti-EpCAM×anti-CD3 ProTIA captured by the rhCD3ε & δ/anti-XTEN sandwich ELISA. The intensity of the color produced (measured OD) was plotted against protein concentration; and the concentration of non-cleavable and protease-uncleaved anti-EpCAM×anti-CD3 ProTIA that gave half-maximal response ($EC_{50}$) was derived with a 4-parameter logistic regression equation using GraphPad prism software.

Figure 68:
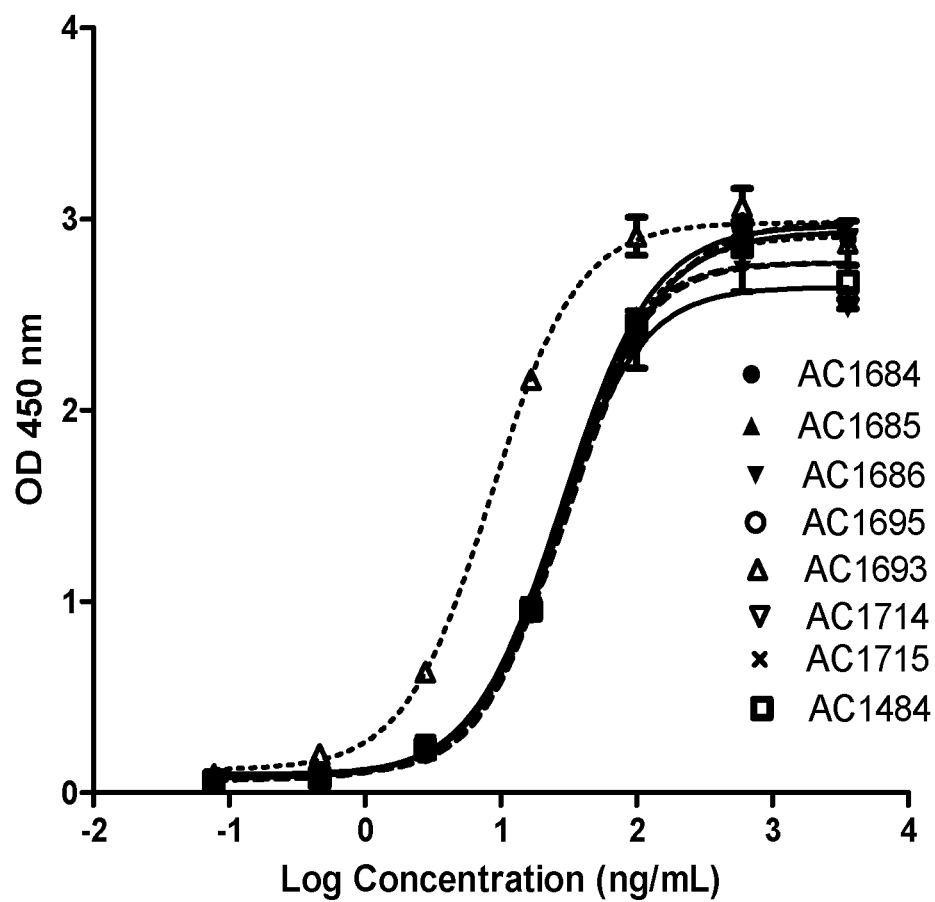
FIG. 68 depicts binding of protease-untreated anti-EpCAM×anti-CD3 variants for CD3epsilon/delta ligand, as described in Example 28.

As shown in FIG. 68, all protease-untreated anti-EpCAM×anti-CD3 ProTIA except for AC1693, has a binding activity similar to that of non-cleavable anti-EpCAM×anti-CD3 bispecific ProTIA molecule AC1484 ($EC_{50}$ of 27 ng/mL). The $EC_{50}$ of AC1684 is 31 ng/mL, AC1685 is 29 ng/mL, AC1686 is 26 ng/mL, AC1695 is 28 ng/mL, AC1714 is 30 ng/mL, and AC1715 is 34 ng/mL. Only AC1693 with an $EC_{50}$ of 9 ng/mL has a 3-fold more active binding than the non-cleavable AC1484 for the rhCD3ε & δ ligand. The data suggest that differences in Release Segment composition can influence the binding of ProTIA to the CD3 antigen found on T cells.

Example 29: Pharmacokinetic Properties of Anti-EpCAM×Anti-CD3 Protease Triggered Immune Activator (ProTIA) Composition The pharmacokinetic properties of protease-untreated anti-EpCAM×anti-CD3 ProTIA variants (e.g. AC1684, AC1685, AC1686, AC1693, AC1695, AC1714, and AC1715) would be analyzed in conjunction with non-cleavable anti-EpCAM×anti-CD3 ProTIA (e.g. AC1484) in C57BL/6 mice. Each ProTIA would be evaluated with three mice per group at an intravenous dose of 4 mg/kg. At appropriate time points of pre-dose, 4 h, 8 h, 24 h, 2 d, 4 d, 6 d and 7 d, blood would be collected into lithium heparinized tubes and processed into plasma. Plasma concentration of ProTIAs would be quantified by a rhEpCAM/biotinylated-anti-XTEN sandwich ELISA with the protease-untreated ProTIA as standard.

Briefly, ELISA plate (Nunc Maxisorp cat #442404) would be coated with 0.1 mircog/100 microL per well of rhEpCAM (R&D Systems, cat #EHH104111). After overnight incubation at 4° C., the ELISA plate would be washed and blocked with 3% BSA for 1 h at room temperature. The plate would then be washed again followed by the appropriate addition of a dose range of protease-untreated and non-cleavable anti-EpCAM×anti-CD3 ProTIA standards, appropriate quality controls and plasma test samples. The plate would be allowed to incubate with shaking for 1 h at room temperature to allow the ProTIA standards, quality controls and test samples to bind to rhEpCAM coated on the plate. Unbound components would be removed with several washes. For detection, biotinylated anti-XTEN antibody would be added at 0.1 microg/100 microL and the plate allowed to incubate at room temperature for 1 h. After washing away unbound biotinylated reagent, streptavidin-HRP (Thermo Scientific cat #21130) would be added at 1:30,000 dilution and plate incubated at room temperature for 1 h. After several washes, TMB substrate would be added to each well. Once desired color intensity is reached, 0.2 N sulfuric acid is added to stop the reaction and absorbance (OD) measured at 450 nm using a spectrophotometer. The intensity of the color is proportional to the concentration of protease-untreated and non-cleavable ProTIA captured by the rhEpCAM/biotinylated-anti-XTEN sandwich ELISA. The concentration of ProTIA present in the plasma samples is determined against the appropriate protease-untreated or non-cleavable ProTIA standard curve using SoftMax Pro software. Pharmacokinetic calculations of terminal half-life ($T_{1/2}$) of the protease-uncleaved and non-cleavable anti-EpCAM×anti-CD3 ProTIA would be performed with GraphPad Prism.

It is expected that the results would show no difference in elimination half-life ($T_{1/2}$) between the different protease-untreated anti-EpCAM×anti-CD3 ProTIA variants, and also against the non-cleavable anti-EpCAM×anti-CD3 ProTIA.

Example 30: PK Properties of Anti-EpCAM×Anti-CD3 Protease Triggered Immune Activator (ProTIA) Composition in OVCAR-3 Ovarian Model Protease-cleaved, protease-untreated and non-cleavable anti-EpCAM×anti-CD3 ProTIAs' PK profile was evaluated as a mixture of independently metal-labeled molecules in the OVCAR-3 tumor bearing BALB/c nude mice. To each irradiated BALB/c nude mice, ten million OVCAR-3 cells are injected intraperitoneally on day 0. Treatment was initiated when abdominal distention was visibly observed and/or when animal body weight had increased by 10-15% over day 0. Out of twenty OVCAR-3 tumor bearing mice, 18 were selected and randomized according to their individual body weight into 2 groups of 9 animals per group. One group of 9 mice was intravenously injected with 1.5 mg/kg of the mixture comprising of equimolar concentration of Lutetium (Lu)-labeled protease-cleaved anti-EpCAM×anti-CD3 ProTIA, Holmium (Ho)-labeled protease-untreated anti-EpCAM×anti-CD3 ProTIA and Terbium (Tb)-labeled non-cleavable anti-EpCAM×anti-CD3 ProTIA. The other group of 9 animals is administered intraperitoneally with 1.5 mg/kg of the same ProTIA mixture.

By alternating between animals within the same group (i.e. intravenously and intraperitoneal administered groups) due to limitations in blood draw and treatment handling per mouse, blood was collected by jugular/mandibular vein puncture into lithium heparin tubes at 0.5 h, 4 h, 8 h, 24 h, 48 h, day 3, day 5 and day 7 post-test article administration. Blood was processed into plasma by centrifugation at 1300 g for 10 minutes at 4° C. and stored at −80° C. till analysis.

Ascites was collected from both intravenously and intraperitoneal administered groups at 4 h, 8 h, 24 h, 48 h, day 3, day 5 and day 7 post-test article administrations by alternating between animals within the same group. Ascites samples were immediately centrifuged at 300 g for 10 minutes at 4° C. and fluid component frozen down at −80° C. until analysis. All samples (blood and ascites) were analyzed by ICP-MS (inductively coupled plasma mass spectrometry).

In the plasma compartment of the intravenous administered arm, Ho-labeled protease-untreated anti-EpCAM×anti-CD3 ProTIA and Tb-labeled non-cleavable anti-EpCAM×anti-CD3 ProTIA demonstrated similar half-life of 19.5 h. As expected, Ho-labeled protease-untreated anti-EpCAM×anti-CD3 ProTIA had a longer systemic half-life compared to the Lu-labeled protease-cleaved anti-EpCAM×anti-CD3 ProTIA (19.5 h vs. 2 h) (FIG. 69A). In the ascites compartment, all 3 ProTIAs were detectable, at low equivalent amount of ~4% injected dose (ID)/g at $T_{max}$ of 48 h. In spite of the low amount, all 3 ProTIAs exhibited a long exposure within the peritoneal cavity as reflected by $AUC_{4-168}$ of ~400% ID/gxh (FIG. 69B)

In the plasma compartment of the intraperitoneal administered arm, Ho-labeled protease-untreated anti-EpCAM×anti-CD3 ProTIA and Tb-labeled non-cleavable anti-EpCAM×anti-CD3 ProTIA reached Cmax at ~8 h, and demonstrated equivalent half-life of 21.4 and 22.9 h, respectively. The Ho-labeled protease-untreated anti-EpCAM×anti-CD3 ProTIA exhibited a longer systemic half-life compared to the Lu-labeled protease-cleaved anti-EpCAM×anti-CD3 ProTIA (21.4 h vs. 6.5 h) (FIG. 70A). In the ascites compartment, Ho-labeled protease-untreated anti-EpCAM×anti-CD3 ProTIA and Tb-labeled non-cleavable anti-EpCAM×anti-CD3 ProTIA were detected at ~10% ID/g at Cmax of 4 h; while Lu-labeled protease-cleaved anti-EpCAM×anti-CD3 ProTIA was detected at ~16% ID/g at Cmax of 48 h. The exposure of Ho-labeled protease-untreated anti-EpCAM×anti-CD3 ProTIA and Tb-labeled non-cleavable anti-EpCAM×anti-CD3 ProTIA were approximately equivalent ($AUC_{4-168}$ 684% ID/gxh), while the exposure of Lu-labeled protease-cleaved anti-EpCAM×anti-CD3 ProTIA appeared to be 2-fold higher with $AUC_{4-168}$ of 1458% ID/gxh (FIG. 70B). This was somewhat unexpected but nonetheless conceivable considering protease-treated ProTIA did not be metabolized by tumor-associated proteases and had immediate access to tumor target and thus better retained in the intraperitoneal tumor environment compared to the protease-untreated and non-cleavable ProTIAs.

Results demonstrated that protease-untreated ProTIA is stable in systemic circulation in OVCAR-3 tumor bearing diseased mice; and has a 10-fold improved half-life compared to protease-treated ProTIA. In the peritoneal cavity, all 3 ProTIAs (i.e. protease-treated, protease-untreated and non-cleavable) had long exposure likely due to tumor target interaction.

Example 31: Caspase 3/7 Assay of Anti-EpCAM×Anti-CD3 Protease Triggered Immune Activator (ProTIA) Composition Redirected cellular cytotoxicity of protease-untreated anti-EpCAM×anti-CD3 ProTIA compositions (e.g. AC1684, AC1685, AC1686, AC1693, AC1695, AC1714, and AC1715) against non-cleavable anti-EpCAM×anti-CD3 ProTIA (e.g. AC1484) was also assessed via caspase 3/7 activities of apoptotic cells. Similar to the caspase cytotoxicity assay described above, PBMC were mixed with EpCAM positive tumor target cells such as HPAF-II (human pancreatic tumor cell line), HCT-116 (human colorectal tumor cell line) and MDA-MB-231 (human triple negative breast cell line) in a ratio of 10 effectors to 1 target; and all ProTIA variants were tested as either a 8-point or a 12-point, 5× serial dilution dose concentrations as in the caspase assay described above. The three cell lines were selected to represent high, mid and low EpCAM antigen expressing cells with HPAF-II expressing 1.1 million EpCAM antigen per cell, HCT-116 500,000 per cell and MDA-MB-231 13,000 per cell.

Upon cell lysis, released caspase 3/7 in culture supernatants was measured by the amount of luminogenic caspase 3/7 substrate cleavage by caspase 3/7 to generate the "glow-type" luminescent signal (Promega Caspase-Glo 3/7 cat #G8091). The amount of luminescence is proportional to the amount of caspase activities.

When evaluated in EpCAM high expressing HPAF-II cell line, the activity among the protease-untreated ProTIA variants ranged from similar (AC1684, AC1685, AC1693, AC1695, AC1714, and AC1715) to ~6-fold less active (AC1686) (Table 13).

When evaluated in EpCAM mid expressing HCT-116 cell line, the activity among the protease-untreated ProTIA variants ranged from similar (AC1684, AC1685, AC1693, AC1695, AC1714, and AC1715) to ~7-fold less active (AC1686) (Table 13).

When evaluated in EpCAM low expressing MDA-MB-231 cell line, all ProTIAs (protease-untreated and non-cleavable) exhibited much lower activity than was observed in the high and mid EpCAM expressing cell lines. The activity among the protease-untreated ProTIA variants ranged from similar (AC1685, AC1686, AC1693, AC1695, AC1714, and AC1715) to 4-fold less active (AC1684) (Table 13).

In line with the activity trend of the protease-untreated versus non-cleavable anti-EpCAM×anti-CD3 ProTIA profiled in above examples, the activity of the non-cleavable ProTIA (e.g. AC1484) is consistently poorer as compared to all the protease-untreated ProTIAs (AC1684, AC1685, AC1686, AC1693, AC1695, AC1714, and AC1715) in all three high, mid and low EpCAM expressing cell lines tested. (The only exception being AC1684 and AC1484 having equivalent activity in MDA-MB-231 cell line.) The fold difference in activity between protease-untreated versus non-cleavable in the EpCAM high expressing HPAF-II is approximately 60-fold, in HCT-116 about 37-fold and in MDA-MB-231 about 3.6-fold.

Results demonstrated that EpCAM expression of approximately ≥500,000 per target cell is sufficient to provide strong cytotoxic activity, while EpCAM expression of approximately ≤13,000 per target cell will induced much poorer cytotoxic activity. Differences in ProTIA Release Segment composition as represented by AC1684, AC1685, AC1686, AC1693, AC1695, AC1714, and AC1715 can influence the cytotoxic activity of ProTIAs to kill a specific target cell in the presence of effector PBMC. Results also demonstrated that non-cleavable ProTIA is consistently less active than the protease-untreated anti-EpCAM×anti-CD3 variants in all three high, mid and low EpCAM expressing cell lines evaluated.

TABLE 13

In vitro cytotoxicity activity of protease-untreated anti-EpCAM × anti-CD3 variants in HPAF-II, HCT-116 and MDA-MB-231 human cell lines

| ProTIA | EC50 (pM) | | |
|---|---|---|---|
| | HPAF-II | HCT-116 | MDA-MB-231 |
| AC1684 | 24 | 32 | 12200 |
| AC1685 | 29 | 27 | 4340 |
| AC1686 | 118 | 240 | 2680 |
| AC1693 | 12 | 21 | 3480 |
| AC1695 | 18 | 53 | 3750 |
| AC1714 | 20 | 52 | 1740 |
| AC1715 | 14 | 20 | 1190 |
| AC1484 | 1170 | 1269 | 10200 |

Example 32: Anti-Tumor Properties of Anti-EpCAM×Anti-CD3 Protease Triggered Immune Activator (ProTIA) Composition in OVCAR-3 Ovarian Model Versus Standard of Care The in vivo efficacy of among protease-untreated anti-EpCAM×anti-CD3 ProTIA variants as well as against bevacizumab would be evaluated using the human platinum-resistant OVCAR-3 ovarian cell line implanted intraperitoneally into the severely immunodeficient NOG (NOD/Shi-scid/IL-2Rg$^{null}$) mice. NOG mice are characterized by the deficiency of T, B and NK cells, as well as the dysfunction of macrophages, dendritic cell and complement system. On day 0, nine cohorts (Groups 1-9) of 6 NOG mice per group would be implanted intraperitoneally with 10×10$^6$ OVCAR-3 cells. When tumor cells are observed to have progressed as monitor by an increase in human CA125 level from baseline (below limit of detection) to approximately 650 U/mL (approximately day 21), 10×10$^6$ of PBMC would be intravenously introduced to Groups 1-9. Treatments would be initiated on day of PBMC inoculation with Group 1 intravenously injected with vehicle (PBS+0.05% Tween 80); Groups 2-8, each intravenously administered with one protease-untreated anti-EpCAM×anti-CD3 ProTIA variants (e.g. AC1684, AC1685, AC1686, AC1693, AC1695, AC1714, and AC1715) at 0.5 mg/kg; and Group 9 intravenously administered with 2 mg/kg bevacizumab. All cohorts would be treated twice per week for 4 weeks. Mice will be monitored daily for behavior and survival, and twice weekly for body weight and abdomen distention. Blood would be collected on day 27, day 34, day 41, and day 48 and at sacrifice for CA125 determination as sign of tumor development. All mice will be sacrificed at day 55 study endpoint, in which time ascites volume will be measured and total number and mass of all tumor nodules found in the peritoneal cavity counted.

Growth of OVCAR-3 tumor would be clearly evidenced by an increase in circulating human CA125 levels. CA125 level in Group 1 vehicle is expected to increase significantly over time. CA125 level in Group 9 bevacizumab is also expected to increase over time but to a lesser extent than that observed in Group 1 vehicle. CA125 levels in Groups 2-7 are expected to decrease over time due to efficacy imparted by the various protease-untreated anti-EpCAM×anti-CD3 ProTIA (e.g. AC1684, AC1685, AC1686, AC1693, AC1695, AC1714, and AC1715). As these variants bear different release segment, there is a good likely hood that differences in degree of efficacy (i.e. magnitude of CA125 decrease) would be observed among the protease-untreated variants.

When monitored by ascites volume and total tumor volume at sacrifice of all animals, intravenous administered protease-untreated anti-EpCAM×anti-CD3 ProTIAs are expected to out-performed Group 1 and 9. Group 1 and 9 are expected to bear ascites volume at sacrifice due to tumor growth. Minimal ascites fluid and tumor nodules are expected in Groups 2 to 8 due to efficacy imparted by the various protease-untreated anti-EpCAMxanti-CD3 ProTIAs. As these variants bear different release segment, there is a good likely hood that differences in degree of efficacy would be observed among the protease-untreated variants.

Example 33: In Vivo Toxicity Assessment of ProTIA Vs. BiTE Equivalent

Toxicity of ProTIA was assessed by using surrogate molecules that bind to mouse EpCAM and mouse CD3E proteins. The main toxicity attributed to this molecule is cytokine release syndrome due to expression of EpCAM positive cells in the mouse lymphocytes. The test articles were AC1553X, AC1553A, and AC1476A. AC1553X is a 138 kDa recombinant molecule consisting of anti-mouse EpCAM scFv fused to an anti-mouseCD3 scFv linked to an 864-amino acid XTEN protein (AE864), described more fully in Example 24. A tumor-associated protease-sensitive cleavage site was engineered between the aCD3 scFv and adjoining XTEN. Insertion of the unique protease cleavage site enables selective cleavage of AC1553X by tumor-associated proteases such as MMP-9, MMP-2, and matriptase to release the fused anti-mouseEpCAM and anti-mouse CD3 scFv cytotoxic moiety. AC1553A is configured in a format equivalent to a BiTE molecule that can be generated by cleavage of the AC1553X by the tumor-associated proteases, and it recognizes mouse EpCAM and mouse CD3δ/E receptors. AC1476A is a bispecific molecule that recognizes human EpCAM and human CD3δ/E receptor, and it is used as a negative control in the toxicity assessment because it does not recognize the mouse EpCAM nor mouse CD3 molecules.

Normal BALB/c mice were dosed with 500 µg of control non-binding BiTE equivalent (AC1476A), varying amount of BiTE equivalent (50, 150, and 500 µg/kg; AC1553A), and matching molar amounts of ProTIA (120, 360, and 1,200 µg/kg; AC1553X). Blood was collected at 0, 2, 4, 6, 8, 10, 24, and 48 hours post-dosing, and cytokine levels for IL-2, IL-4, IL-6, IL-10, TNF-a, and INF-g were determined by luminex assay using Milliplex cytokine analysis kits (catalog #MHSTCMAG-70K).

Results: Except for interferon-gamma (IFN-g; FIG. 71E), all of the cytokines for AC1553A were significantly higher than that of AC1553X at the corresponding dose (see results, FIG. 71). The max cytokine induction for IL-2, IL-4, IL-6, and TNF-a for AC1553A was at ~4h. post-dosing, and for IL-10 and INF-g was at ~10h post-dosing. The induction of cytokines for AC1553X in general was delayed to ~6-10h. post-dosing, and the magnitude of induction was much lower than that of AC1553A. There was very little or undetectable induction of cytokines by the control AC1476A treatment. Results from mice treated with control AC1476A are in light circle, with 50ug/kg of AC1553A are in open diamond dotted line, with 150ug/kg of AC1553A are in open diamond dashed line, and with 500ug/kg of AC1553A are in open diamond solid line. Results from mice treated with 120 ug/kg of AC1553X are in black triangle dotted line, with 360 ug/kg of AC1553X are in black triangle dashed line, and with 1,200 µg/kg of AC1553X are in black triangle solid line. Cytokine concentrations are shown in picogram per mL of serum plotted against time of blood collection.

Conclusions: The cytokine induction is much higher for AC1553A treatment than that of AC1553X indicating a much greater cytokine release syndrome (CRS) in AC1553A-treated mice vs. AC1553X-treated mice. This was particularly the case for IL-6 (FIG. 71C), which is a clinical-relevant parameter and key target for CRS treatment. For IL-6, the highest dose of AC1553A produced IL-6 levels similar to that of the lowest dose of AC1553X treatment and given that the dosing difference is 10-fold, it suggests that AC1553X has a 10-fold improvement on safety in causing CRS relative to that of AC1553A.

Example 34: Determination of the Maximum Tolerated Dose of ProTIA in C57BL/6 Mice Toxicity of ProTIA was assessed by using a surrogate molecule that binds to mouse EpCAM and mouse CD3E proteins. The main toxicity attributed to this molecule is cytokine release syndrome due to expression of EpCAM positive cells in the mouse lymphocytes. The test articles were AC1553X and AC1553A, described in Example 24. Normal C57BL/6 mice were dosed with varying amount of AC1553A (50, 150, and 500 µg/kg), and matching molar amounts of AC1553X (120, 360, and 1,200 µg/kg), and health and body weight of the mice were monitored for 14 days post-dosing.

Figure 72:
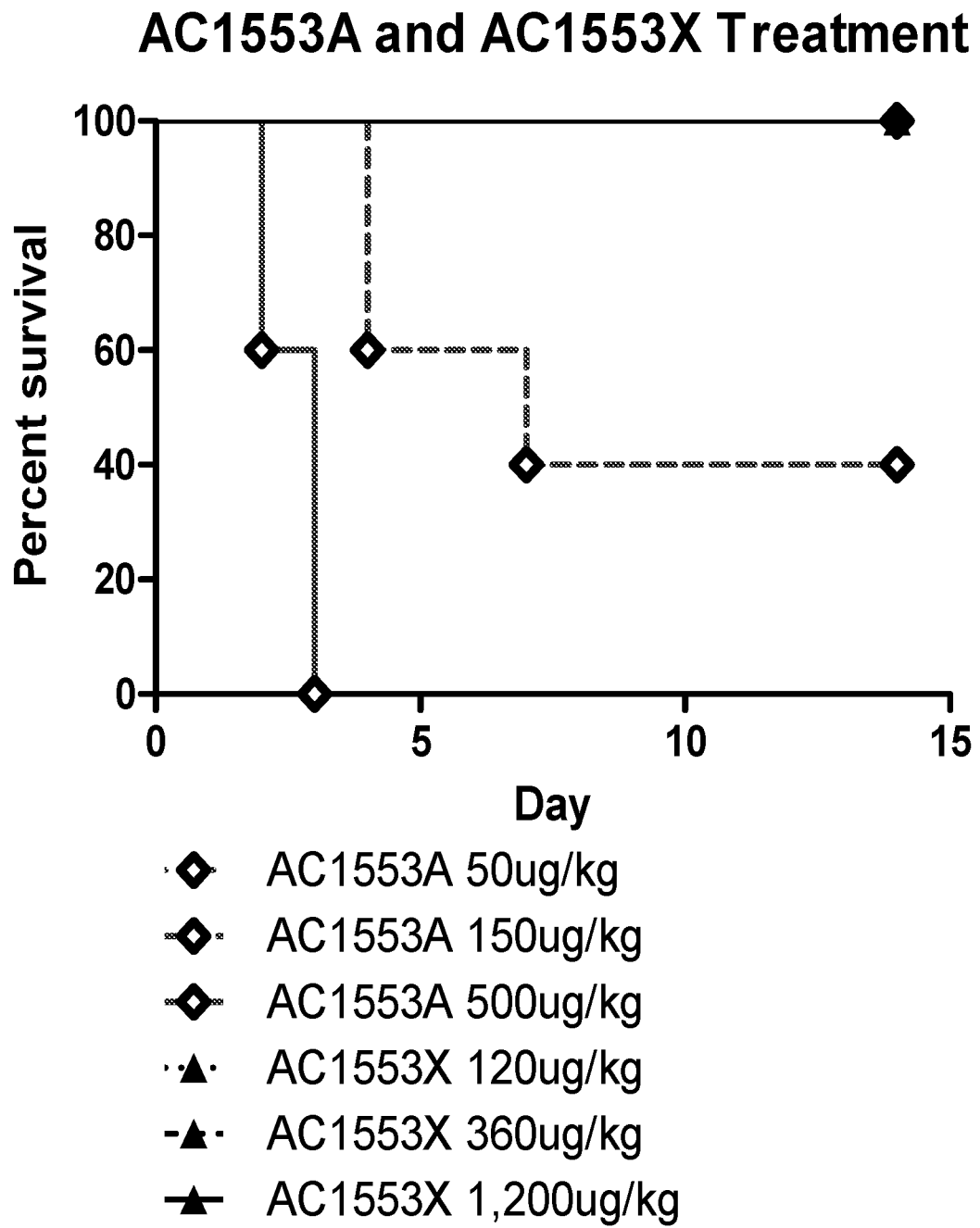
FIG. 72 shows the results from an experiment to determine the maximum tolerated dose of an intact ProTIA compared to the cleaved, activated form, graphed as a Kaplan-Meier plot, as described in Example 34.

Mice that were treated with the high dose of AC1553A (500 µg/kg) all died by the third day post-treatment (5 out of 5 mice), and mice treated with the mid dose of AC1553A (150 µg/kg) resulted in death of 3 out of the 5 mice during the study (FIG. 72). The low dose of AC1553A did not result in any mouse deaths. This is in contrast to AC1553X treatment, where all of the mice were alive after matching molar equivalent amount of AC1553A. FIG. 72 depicts a Kaplan-Meier plot of AC1553X and AC1553A treatment of C57BL/6 mice. 5 mice per group were treated with 120 µg/kg of AC1553X (black triangle dotted line), 360 µg/kg of AC1553X (black triangle dashed line), and 1,200 µg/kg of AC1553X (black triangle solid line), and matching molar amounts of AC1553A. 50 µg/kg of AC1553A shown in an open diamond dotted line, 150 µg/kg of AC1553A shown in an open diamond dashed line, and 500 µg/kg of AC1553A in an open diamond solid line (the percentage of surviving mice was plotted against various time points).

Results: Mice that were treated with high dose of AC1553A (500 µg/kg) exhibited greater than 10% body weight loss after 2 days of treatment, and all of the mice died within 3 days (FIG. 73A). Mice that were treated with mid dose of AC1553A (150 µg/kg) displayed 10-20% body weight loss within 2-4 days post dosing, and 3 mice died while the body weight of the remaining two mice recovered to pre-dosing body weight levels (FIG. 73B) Mice treated with low dose of AC1553A (50 µg/kg) displayed a temporary weight loss within 10% at 2 days following treatment, and all of the body weights of the mice recovered to equal or above pre-dosing levels (FIG. 73C). For AC1553X, the high dose (1,200 µg/kg) mice displayed body weight loss of greater than 10% after 2-3 days post-dosing, but all of the body weights recovered to normal levels (FIG. 73F) For mid and low dosing of AC1553X, the body weight loss is insignificant (FIG. 73D, E) Percent weight change is plotted against time post drug dosing. Percent weight is calculated by taking the weight of the mice at times post-drug dosing and divided by the original pre-drug dosing weight and multiply by 100 [(post-drug dose weight/pre-drug dose weight)×100]. 5 mice per group were treated with 120 µg/kg of AC1553X (black triangle dotted lines), 360 µg/kg of AC1553X (black triangle dashed lines), 1,200 µg/kg of AC1553X (black triangle solid lines), and matching molar amounts of AC1553A. 50 µg/kg of AC1553A shown in open diamond dotted lines, 150 µg/kg of AC1553A shown in open diamond dashed lines, and 500 µg/kg of AC1553A in open diamond solid lines. Each line represents weight changes of one mouse.

Conclusions: The fact that 3 of 5 mice died when treated with mid dose of AC1553A and all of the mice (5 out of 5) died with high dose suggests that the maximum tolerable dose of AC1553A in mice is between 50 to 150 µg/kg. Since all of the mice treated with AC1553X at various amounts of drug are alive, the results suggest that the maximum tolerable dose for AC1553X in mice is greater than 1,200 µg/kg.

Example 35: Binding Affinity of Anti-EpCAM×Anti-CD3 Protease Triggered Immune Activator (ProTIA) Composition The binding affinity of anti-EpCAM×anti-CD3 ProTIA (e.g. AC1476) to human EpCAM and human CD3 was measured by two methods: 1) using surface plasmon resonance with recombinant EpCAM and CD3 antigens and 2) using flow cytometry with EpCAM and CD3 expressing cells. Note that AC1516 is the codon-optimized version of AC1476 and they share the same amino acid sequence.

Surface plasmon resonance (SPR) binding experiments were performed on a Biacore 3000. To assess binding of anti-EpCAM×anti-CD3 ProTIA to human EpCAM, Fc-tagged EpCAM (R&D Systems, cat #960-EP-050) was captured on a carboxy-methylated dextran chip using 1-ethyl-3-(3-dimethylaminopropyl) carbodiimide (EDC) and N-hydroxysuccinimide (NHS). Then binding of each of the three ProTIA molecules [untreated (e.g. AC1516), protease-treated (e.g. MMP-9 treated AC1516), and non-cleavable (e.g. AC1484) anti-EpCAM×anti-CD3 to the EpCAM chip was performed at 5-6 difference concentrations for full kinetic analysis and $K_d$ determination. The $K_d$ for binding to human EpCAM was determined to be 11.4 nM for untreated anti-EpCAM×anti-CD3 ProTIA, 1.15 nM for protease-treated ProTIA, and 10.0 nM for non-cleavable ProTIA.

To assess binding of anti-EpCAM×anti-CD3 ProTIA to human CD3, His-tagged CD3εδ (Creative Biomart, cat #CD3E&CD3D-219H) was captured on a carboxy-methylated dextran chip using EDC and NHS. Then binding of each of the three ProTIA molecules [untreated (e.g. AC1516), protease-treated (e.g. MMP-9 treated AC1516), and non-cleavable (e.g. AC1484) anti-EpCAM×anti-CD3] to the CD3 chip was performed at 5-6 difference concentrations for full kinetic analysis and $K_d$ determination. The $K_d$ for binding to human CD3 was determined to be 15.3 nM for untreated anti-EpCAM×anti-CD3 ProTIA, 2.22 nM for protease-treated ProTIA, and 27.8 nM for non-cleavable ProTIA.

The binding constants for anti-EpCAM×anti-CD3 ProTIA binding to EpCAM-expressing and CD3-expressing cells were determined by competition binding with a fluorescently-labeled, protease-treated ProTIA. The fluorescently-labeled, protease-treated ProTIA was made by conjugation of Alexa Fluor 647 C2 maleimide (Thermo Fisher, cat #A20347) to a cysteine-containing, protease-treated ProTIA mutant (MMP-9 treated AC1531). Binding experiments were performed on 10,000 cells at 4° C. for 1 hour in a total volume of 100 microL of binding buffer (1% bovine serum albumin in phosphate-buffered saline). Cells were washed once with cold binding buffer, then re-suspended in 2% formaldehyde in phosphate-buffered saline and immediately analyzed on a Millipore Guava easyCyte flow cytometer. Binding of the fluorescently-labeled, protease-treated ProTIA revealed an apparent $K_d$ of 0.85 nM to CHO cells stably transfected with human EpCAM (EpCAM-CHO) and 2.6 nM to CD3+ Jurkat cells. Competition binding of the fluorescently-labeled, protease-treated ProTIA to EpCAM-CHO cells resulted in apparent binding constants of 2.9 nM for untreated anti-EpCAM×anti-CD3 ProTIA (e.g. AC1476) and 0.29 nM for protease-treated ProTIA (e.g. MMP-9 treated AC1476). Competition binding of the fluorescently-labeled, protease-treated ProTIA to CD3+ Jurkat cells resulted in apparent binding constants of 31 nM for untreated anti-EpCAM×anti-CD3 ProTIA (e.g. AC1476) and 1.1 nM for protease-treated ProTIA (e.g. MMP-9 treated AC1476).

The binding affinity to EpCAM for the protease-treated ProTIA was about 10-fold stronger than untreated and non-cleavable ProTIA by both SPR and flow cytometry. The binding affinity to CD3 for the protease-treated ProTIA was stronger than untreated and non-cleavable ProTIA: about 10-fold by SPR and about 30-fold by flow cytometry. These data support the conclusion that XTEN reduces the binding affinity of the intact, untreated ProTIA prodrug form compared to the protease-treated activated ProTIA. The reduction in binding affinity to both EpCAM and CD3 makes the untreated ProTIA less likely to bind to its targets in the circulation or healthy tissues.

Example 36: T-Cell Activation Marker Assays of Anti-EpCAM×Anti-CD3 Protease Triggered Immune Activator (ProTIA) Composition To measure the anti-EpCAM×anti-CD3 ProTIA induced activation markers (CD69 and CD25), $1\times10^5$ PBMC or purified CD3+ cells would be co-cultured in RPMI-1640 containing 10% FCS with $2\times10^4$ SK-OV-3 or OVCAR3 cells per assay well (i.e., effector to target ratio of 5:1) in the presence of anti-EpCAM×anti-CD3 ProTIA (e.g. AC1695) in a 96-well round-bottom plate with total final volume of 200 microL. After 20 h incubation in a 37° C., 5% CO2 humidified incubator, cells would be stained with PECy5-conjugated anti-CD4, APC-conjugated anti-CD8, PE-conjugated anti-CD25, and FITC-conjugated anti-CD69 (all antibodies from BioLegend) in FACS buffer (1% BSA/PBS) at 4° C., washed twice with FACS buffer, and then re-suspended in FACS buffer for acquisition on a Guava easyCyte flow cytometer (Millipore).

T-cell activation marker expression is expected to have a similar trend for the three ProTIA molecules [untreated (e.g. AC1695), protease-treated (e.g. MMP-9 treated AC1695), and non-cleavable (e.g. AC1484) anti-EpCAM×anti-CD3] as was observed by caspase 3/7 cytotoxicity assay. Using SK-OV-3 cells, activation of CD69 on CD8 and CD4 populations of PBMC by untreated anti-EpCAM×anti-CD3 ProTIA (e.g. AC1695) is expected to be ~50-100-fold less active than protease-treated ProTIA (e.g. MMP-9 treated AC1695); and the non-cleavable anti-EpCAM×anti-CD3 ProTIA (e.g. AC1484) is expected to be ~1000-fold less active than the protease-cleaved ProTIA (e.g. MMP-9 treated AC1695).

Example 37: Cytokine Release Assays of Anti-EpCAM×Anti-CD3 Protease Triggered Immune Activator (ProTIA) Composition To measure the anti-EpCAM×anti-CD3 ProTIA induced expression of cytokines, $1\times10^5$ purified CD3+ cells would be co-cultured with $2\times10^4$ SK-OV-3 cells per assay well (i.e., effector to target ratio of 5:1) in the presence of anti-EpCAM×anti-CD3 ProTIA (e.g. AC1695) in a 96-well round-bottom plate with total final volume of 200 microL. After 20 h incubation in a 37° C., 5% CO2 humidified incubator, cell supernatant would be harvested for cytokine measurements. This assay can also be performed with other target cells selected from HCT-116, Kato III, MDA-MB-453, MCF-7, MKN45, MT3, NCI-N87, SK-Br-3, SW480, OVCAR3 and PC3 cell lines as well as PBMC in place of purified CD3+ cells.

Cytokine analysis of interleukin (IL)-2, IL-4, IL-6, IL-10, tumor necrosis factor (TNF)-alpha and interferon (IFN)-gamma secreted into the cell culture supernatant would be quantitated using the Human Th1/Th2 Cytokine Cytometric Bead Array (CBA) kit (BD Biosciences cat #550749) following manufacturer's instruction. In the absence of ProTIA, no cytokine secretion above background is expected from purified CD3+ cells. ProTIA in the presence of EpCAM-positive target cells and purified CD3+ cells is expected to activate T cells and secrete a pattern of T cell cytokines with a high proportion of Th1 cytokines such as IFN-gamma and TNF-alpha.

Anti-EpCAM×anti-CD3 ProTIA is expected to induce robust secretion of all cytokines (IL-2, IL-4, IL-6, IL-10, TNF-alpha, IFN-gamma) that would be evaluated (see FIGS. 50-52). Stimulation of purified CD3+ cells with SK-OV-3 cells and protease-treated anti-EpCAM×anti-CD3 ProTIA (e.g. MMP-9 treated AC1695) is expected to trigger significant cytokine expression, especially at concentrations higher than 20 pM for all of the cytokines that would be tested. In contrast, baseline levels of IL-2, IL-4, IL-6, IL-10, TNF-alpha and IFN-gamma are expected when the intact non-cleaved anti-EpCAM×anti-CD3 ProTIA molecule (e.g. AC1695) is used at a concentration up to about 100 pM. Additionally, baseline levels of all cytokines that would be tested are expected for the non-cleavable anti-EpCAM×anti-CD3 ProTIA molecule (e.g. AC1484) at concentrations up to about 1 nM.

Example 38: Binding Affinity of Anti-EpCAM×Anti-CD3 Protease Triggered Immune Activator (ProTIA) Composition The binding affinity of anti-EpCAM×anti-CD3 ProTIA (e.g. AC1695) to human EpCAM and human CD3 would be measured using flow cytometry with EpCAM and CD3 expressing cells.

The binding constants for anti-EpCAM×anti-CD3 ProTIA binding to EpCAM-expressing and CD3-expressing cells would be measured by competition binding with a fluorescently-labeled, protease-treated ProTIA. The fluorescently-labeled, protease-treated ProTIA was made by conjugation of Alexa Fluor 647 C2 maleimide (Thermo Fisher, cat #A20347) to a cysteine-containing, protease-treated ProTIA mutant (MMP-9 treated AC1531). Binding experiments would be performed on 10,000 cells at 4° C. for 1 hour in a total volume of 100 microL of binding buffer (1% bovine serum albumin in phosphate-buffered saline). Cells would be washed once with cold binding buffer, then re-suspended in 2% formaldehyde in phosphate-buffered saline and immediately analyzed on a Millipore Guava easyCyte flow cytometer. Binding of the fluorescently-labeled, protease-treated ProTIA would be expected to have an apparent $K_d$ value of approximately 1 nM to CHO cells stably transfected with human EpCAM (EpCAM-CHO) and approximately 3 nM to CD3+ Jurkat cells. Competition binding of the fluorescently-labeled, protease-treated ProTIA to EpCAM-CHO cells is expected to result in apparent binding constants of single-digit nM for untreated anti-EpCAM×anti-CD3 ProTIA (e.g. AC1695) and sub-nM for protease-treated ProTIA (e.g. MMP-9 treated AC1695). Competition binding of the fluorescently-labeled, protease-treated ProTIA to CD3+ Jurkat cells is expected to result in apparent binding constants of double-digit nM for untreated anti-EpCAM×anti-CD3 ProTIA (e.g. AC1695) and approximately single-digit nM for protease-treated ProTIA (e.g. MMP-9 treated AC1695).

Table 14: Amino acid sequences of ProTIA constructs

TABLE 14

Amino acid sequences of ProTIA constructs

| Construct ID | Tumor Targets | Amino Acid Sequences |
|---|---|---|
| AC1277 | CD19 | HHHHHHHHDIQLTQSPASLAVSLGQRATISCKASQSVDYDGDSYLNWYQQIPGQPPKL LIYDASNLVSGIPPRFSGSGSGTDFTLNIHPVEKVDAATYHCQQSTEDPWTFGGGTKL EIKGGGGSGGGGSGGGGSQVQLQQSGAELVRPGSSVKISCKASGYAFSSYWMNWVKQR PGQGLEWIGQIWPGDGDTNYNGKFKGKATLTADESSSTAYMQLSSLASEDSAVYFCAR RETTTVGRYYYAMDYWGQGTTVTVSSGGGGSDIKLQQSGAELARPGASVKMSCKTSGY TFTRYTMHWVKQRPGQGLEWIGYINPSRGYTNYNQKFKDKATLTTDKSSSTAYMQLSS LTSEDSAVYYCARYYDDHYCLDYWGQGTTLTVSSVEGGSGGSGGSGGSGGVDDIQLTQ SPAIMSASPGEKVTMTCRASSSVSYMNWYQQKSGTSPKRWIYDTSKVASGVPYRFSGS GSGTSYSLTISSMEAEDAATYYCQQWSSNPLTFGAGTKLELKGTAEAASASGLSGRSD NHSPLGLAGSPGSPAGSPTSTEEGTSESATPESGPGTSTEPSEGSAPGSPAGSPTSTE EGTSTEPSEGSAPGTSTEPSEGSAPGTSESATPESGPGSEPATSGSETPGSEPATSGS ETPGSPAGSPTSTEEGTSESATPESGPGTSTEPSEGSAPGTSTEPSEGSAPGSPAGSP TSTEEGTSTEPSEGSAPGTSTEPSEGSAPGTSESATPESGPGTSTEPSEGSAPGTSES ATPESGPGSEPATSGSETPGTSTEPSEGSAPGTSTEPSEGSAPGTSESATPESGPGTS ESATPESGPGSPAGSPTSTEEGTSESATPESGPGSEPATSGSETPGTSESATPESGPG TSTEPSEGSAPGTSTEPSEGSAPGTSTEPSEGSAPGTSTEPSEGSAPGTSTEPSEGSA PGTSTEPSEGSAPGSPAGSPTSTEEGTSTEPSEGSAPGTSESATPESGPGSEPATSGS ETPGTSESATPESGPGSEPATSGSETPGTSESATPESGPGTSTEPSEGSAPGTSESAT PESGPGSPAGSPTSTEEGSPAGSPTSTEEGSPAGSPTSTEEGTSESATPESGPGTSTE PSEGSAPGTSESATPESGPGSEPATSGSETPGTSESATPESGPGSEPATSGSETPGTS ESATPESGPGTSTEPSEGSAPGSPAGSPTSTEEGTSESATPESGPGSEPATSGSETPG TSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTS TEEGTSTEPSEGSAPGTSTEPSEGSAPGSEPATSGSETPGTSESATPESGPGTSTEPS EGSAPG (SEQ ID NO.: 933) |
| AC1278 | EpCAM | HHHHHHHHELVMTQSPSSLTVTAGEKVTMSCKSSQSLLNSGNQKNYLTWYQQKPGQPP KLLIYWASTRESGVPDRFTGSGSGTDFTLTISSVQAEDLAVYYCQNDYSYPLTFGAGT KLEIKGGGGSGGGGSGGGGSEVQLLEQSGAELVRPGTSVKISCKASGYAFTNYWLGWV KQRPGHGLEWIGDIFPGSGNIHYNEKFKGKATLTADKSSSTAYMQLSSLTFEDSAVYF CARLRNWDEPMDYWGQGTTVTVSSGGGGSDVQLVQSGAEVKKPGASVKVSCKASGYTF TRYTMHWVRQAPGQGLEWIGYINPSRGYTNYADSVKGRFTITTDKSTSTAYMELSSLR SEDTATYYCARYYDDHYCLDYWGQGTTVTVSSGEGTSTGSGGSGGSGGADDIVLTQSP ATLSLSPGERATLSCRASQSVSYMNWYQQKPGKAPKRWIYDTSKVASGVPARFSGSGS GTDYSLTINSLEAEDAATYYCQQWSSNPLTFGGGTKVEIKGTAEAASASGLSGRSDNH SPLGLAGSPGSPAGSPTSTEEGTSESATPESGPGTSTEPSEGSAPGSPAGSPTSTEEG TSTEPSEGSAPGTSTEPSEGSAPGTSESATPESGPGSEPATSGSETPGSEPATSGSET PGSPAGSPTSTEEGTSESATPESGPGTSTEPSEGSAPGTSTEPSEGSAPGSPAGSPTS TEEGTSTEPSEGSAPGTSTEPSEGSAPGTSESATPESGPGTSTEPSEGSAPGTSESAT PESGPGSEPATSGSETPGTSTEPSEGSAPGTSTEPSEGSAPGTSESATPESGPGTSES ATPESGPGSPAGSPTSTEEGTSESATPESGPGSEPATSGSETPGTSESATPESGPGTS TEPSEGSAPGTSTEPSEGSAPGTSTEPSEGSAPGTSTEPSEGSAPGTSTEPSEGSAPG TSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEPS EGSAPGTSESATPESGPGSEPATSGSETPGTSESATPESGPGSEPATSGSETPGTSES ATPESGPGTSTEPSEGSAPGSPAGSPTSTEEGTSESATPESGPGSEPATSGSETPGTS ESATPESGPGSPAGSPTSTEEGSPAGSPTSTEEGTSTEPSEGSAPGTSESATPESGPG TSESATPESGPGTSESATPESGPGSEPATSGSETPGSEPATSGSETPGSPAGSPTSTE EGTSTEPSEGSAPGTSTEPSEGSAPGSEPATSGSETPGTSESATPESGPGTSTEPSEG SAPG (SEQ ID NO.: 934) |
| AC1345 | EpCAM | HHHHHHHHEVQLLEQSGAELVRPGTSVKISCKASGYAFTNYWLGWVKQRPGHGLEWIG DIFPGSGNIHYNEKFKGKATLTADKSSSTAYMQLSSLTFEDSAVYFCARLRNWDEPMD YWGQGTTVTVSSGGGGSDVQLVQSGAEVKKPGASVKVSCKASGYTFTRYTMHWVRQAP GQGLEWIGYINPSRGYTNYADSVKGRFTITTDKSTSTAYMELSSLRSEDTATYYCARY YDDHYCLDYWGQGTTVTVSSGEGTSTGSGGSGGSGGADDIVLTQSPATLSLSPGERAT LSCRASQSVSYMNWYQQKPGKAPKRWIYDTSKVASGVPARFSGSGSGTDYSLTINSLE AEDAATYYCQQWSSNPLTFGGGTKVEIKGGGGSELVMTQSPSSLTVTAGEKVTMSCKS SQSLLNSGNQKNYLTWYQQKPGQPPKLLIYWASTRESGVPDRFTGSGSGTDFTLTISS VQAEDLAVYYCQNDYSYPLTFGAGTKLEIKGTAEAASASGLSGRSDNHSPLGLAGSPG SPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTS TEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG |

TABLE 14-continued

Amino acid sequences of ProTIA constructs

| Construct ID | Tumor Targets | Amino Acid Sequences |
|---|---|---|
| | | TSTEPSEGSAPGTSTEPSEGSAPGTSTEPSEGSAPGTSTEPSEGSA<br>PGSPAGSPTSTEEGTSTEPSEGSAPGTSESATPESGPGSEPATPGTSESATPE<br>SGPGSEPATSGSETPGTSESATPESGPGTSTEPSEGSAPGTSESATPESGPGSPAGSP<br>TSTEEGSPAGSPTSTEEGSPAGSPTSTEEGTSESATPESGPGTSTEPSEGSAPGTSES<br>ATPESGPGSEPATSGSETPGTSESATPESGPGSEPATSGSETPGTSESATPESGPGTS<br>TEPSEGSAPGSPAGSPTSTEEGTSESATPESGPGSEPATSGSETPGTSESATPESGPG<br>SPAGSPTSTEEGSPAGSPTSTEEGTSTEPSEGSAPGTSESATPESGPGTSESATPESG<br>PGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGSAPG<br>(SEQ ID NO.: 935) |
| AC1346 | EpCAM | HHHHHHHDVQLVQSGAEVKKPGASVKVSCKASGYTFTRYTMHWVRQAPGQGLEWIGY<br>INPSRGYTNYADSVKGRFTITTDKSTSTAYMELSSLRSEDTATYYCARYYDDHYCLDY<br>WGQGTTVTVSSGGSELVMTQSPSSLTVTAGEKVTMSCKSSQSLLNSGNQKNYLTWYQQ<br>KPGQPPKLLIYWASTRESGVPDRFTGSGSGTDFTLTISSVQAEDLAVYYCQNDYSYPL<br>TFGAGTKLEIKGGGGSGGGGSGGGGSEVQLLEQSGAELVRPGTSVKISCKASGYAFTN<br>YWLGWVKQRPGHGLEWIGDIFPGSGNIHYNEKFKGKATLTADKSSSTAYMQLSSLTFE<br>DSAVYFCARLRNWDEPMDYWGQGTTVTVSSGGGSDIVLTQSPATLSLSPGERATLSCR<br>ASQSVSYMNWYQQKPGKAPKRWIYDTSKVASGVPARFSGSGSGTDYSLTINSLEAEDA<br>ATYYCQQWSSNPLTFGGGTKVEIKGTAEAASASGLSGRSDNHSPLGLAGSPGSPAGSP<br>TSTEEGTSESATPESGPGTSTEPSEGSAPGSPAGSPTSTEEGTSTEPSEGSAPGTSTE<br>PSEGSAPGTSESATPESGPGSEPATSGSETPGSEPATSGSETPGSPAGSPTSTEEGTS<br>ESATPESGPGTSTEPSEGSAPGTSTEPSEGSAPGSPAGSPTSTEEGTSTEPSEGSAPG<br>TSTEPSEGSAPGTSESATPESGPGTSTEPSEGSAPGTSESATPESGPGSEPATSGSET<br>PGTSTEPSEGSAPGTSTEPSEGSAPGTSESATPESGPGTSESATPESGPGSPAGSPTS<br>TEEGTSESATPESGPGSEPATSGSETPGTSESATPESGPGTSTEPSEGSAPGTSTEPS<br>EGSAPGTSTEPSEGSAPGTSTEPSEGSAPGTSTEPSEGSAPGTSTEPSEGSAPGSPAG<br>SPTSTEEGTSTEPSEGSAPGTSESATPESGPGSEPATSGSETPGTSESATPESGPGSE<br>PATSGSETPGTSESATPESGPGTSTEPSEGSAPGTSESATPESGPGSPAGSPTSTEEG<br>SPAGSPTSTEEGSPAGSPTSTEEGTSESATPESGPGTSTEPSEGSAPGTSESATPESG<br>PGSEPATSGSETPGTSESATPESGPGSEPATSGSETPGTSESATPESGPGTSTEPSEG<br>SAPGSPAGSPTSTEEGTSESATPESGPGSEPATSGSETPGTSESATPESGPGSPAGSP<br>TSTEEGSPAGSPTSTEEGTSTEPSEGSAPGTSESATPESGPGTSESATPESGPGTSES<br>ATPESGPGSEPATSGSETPGSEPATSGSETPGSPAGSPTSTEEGTSTEPSEGSAPGTS<br>TEPSEGSAPGSEPATSGSETPGTSESATPESGPGTSTEPSEGSAPG<br>(SEQ ID NO.: 936) |
| AC1357 | EpCAM | HHHHHHHHELVMTQSPSSLTVTAGEKVTMSCKSSQSLLNSGNQKNYLTWYQQKPGQPP<br>KLLIYWASTRESGVPDRFTGSGSGTDFTLTISSVQAEDLAVYYCQNDYSYPLTFGAGT<br>KLEIKGGGGSGGGGSGGGGSEVQLLEQSGAELVRPGTSVKISCKASGYAFTNYWLGWV<br>KQRPGHGLEWIGDIFPGSGNIHYNEKFKGKATLTADKSSSTAYMQLSSLTFEDSAVYF<br>CARLRNWDEPMDYWGQGTTVTVSSGGGGSDVQLVQSGAEVKKPGASVKVSCKASGYTF<br>TRYTMHWVRQAPGQGLEWIGYINPSRGYTNYADSVKGRFTITTDKSTSTAYMELSSLR<br>SEDTATYYCARYYDDHYCLDYWGQGTTVTVSSGEGTSTGSGGSGGSGGADDIVLTQSP<br>ATLSLSPGERATLSCRASQSVSYMNWYQQKPGKAPKRWIYDTSKVASGVPARFSGSGS<br>GTDYSLTINSLEAEDAATYYCQQWSSNPLTFGGGTKVEIKGSPGSPAGSPTSTEEGTS<br>ESATPESGPGTSTEPSEGSAPGSPAGSPTSTEEGTSTEPSEGSAPGTSTEPSEGSAPG<br>TSESATPESGPGSEPATSGSETPGSEPATSGSETPGSPAGSPTSTEEGTSESATPESG<br>PGTSTEPSEGSAPGTSTEPSEGSAPGSPAGSPTSTEEGTSTEPSEGSAPGTSTEPSEG<br>SAPGTSESATPESGPGTSTEPSEGSAPGTSESATPESGPGSEPATSGSETPGTSTEPS<br>EGSAPGTSTEPSEGSAPGTSESATPESGPGTSESATPESGPGSPAGSPTSTEEGTSES<br>ATPESGPGSEPATSGSETPGTSESATPESGPGTSTEPSEGSAPGTSTEPSEGSAPGTS<br>TEPSEGSAPGTSTEPSEGSAPGTSTEPSEGSAPGTSTEPSEGSAPGSPAGSPTSTEEG<br>TSTEPSEGSAPGTSESATPESGPGSEPATSGSETPGTSESATPESGPGSEPATSGSET<br>PGTSESATPESGPGTSTEPSEGSAPGTSESATPESGPGSPAGSPTSTEEGSPAGSPTS<br>TEEGSPAGSPTSTEEGTSESATPESGPGTSTEPSEGSAPGTSESATPESGPGSEPATS<br>GSETPGTSESATPESGPGSEPATSGSETPGTSESATPESGPGTSTEPSEGSAPGSPAG<br>SPTSTEEGTSESATPESGPGSEPATSGSETPGTSESATPESGPGSPAGSPTSTEEGSP<br>AGSPTSTEEGTSTEPSEGSAPGTSESATPESGPGTSESATPESGPGTSESATPESGPG<br>SEPATSGSETPGSEPATSGSETPGSPAGSPTSTEEGTSTEPSEGSAPGTSTEPSEGSA<br>PGSEPATSGSETPGTSESATPESGPGTSTEPSEGSAPG<br>(SEQ ID NO.: 937) |
| AC1358 | EpCAM | HHHHHHHHELVMTQSPSSLTVTAGEKVTMSCKSSQSLLNSGNQKNYLTWYQQKPGQPP<br>KLLIYWASTRESGVPDRFTGSGSGTDFTLTISSVQAEDLAVYYCQNDYSYPLTFGAGT<br>KLEIKGGGGSGGGGSGGGGSEVQLLEQSGAELVRPGTSVKISCKASGYAFTNYWLGWV<br>KQRPGHGLEWIGDIFPGSGNIHYNEKFKGKATLTADKSSSTAYMQLSSLTFEDSAVYF<br>CARLRNWDEPMDYWGQGTTVTVSSGGGGSDIQMTQSPSSLSASVGDRVTITCRASQDI<br>RNYLNWYQQKPGKAPKLLIYYTSRLESGVPSRFSGSGSGTDYTLTISSLQPEDFATYY<br>CQQGNTLPWTFGQGTKVEIKRTSGPGDGGKGGPGKPGGEGTKGTGPGGEVQLVESGG<br>GLVQPGGSLRLSCAASGYSFTGYTMNWVRQAPGKGLEWVALINPYKGVSTYNQKFKDR<br>FTISVDKSKNTAYLQMNSLRAEDTAVYYCARSYYGDSDWYFDVWGQGTLVTVSSGTA<br>EAASASGLSGRSDNHSPLGLAGSPGSPAGSPTSTEEGTSESATPESGPGTSTEPSEGS<br>APGSPAGSPTSTEEGTSTEPSEGSAPGTSTEPSEGSAPGTSESATPESGPGSEPATSG<br>SETPGSEPATSGSETPGSPAGSPTSTEEGTSESATPESGPGTSTEPSEGSAPGTSTEP |

TABLE 14-continued

Amino acid sequences of ProTIA constructs

| Construct ID | Tumor Targets | Amino Acid Sequences |
|---|---|---|
| | | SEGSAPGSPAGSPTSTEEGTSTEPSEGSAPGTSTEPSEGSAPGTSESATPESGPGTST<br>EPSEGSAPGTSESATPESGPGSEPATSGSETPGTSTEPSEGSAPGTSTEPSEGSAPGT<br>SESATPESGPGTSESATPESGPGSPAGSPTSTEEGTSESATPESGPGSEPATSGSETP<br>GTSESATPESGPGTSTEPSEGSAPGTSTEPSEGSAPGTSTEPSEGSAPGTSTEPSEGS<br>APGTSTEPSEGSAPGTSTEPSEGSAPGSPAGSPTSTEEGTSTEPSEGSAPGTSESATP<br>ESGPGSEPATSGSETPGTSESATPESGPGSEPATSGSETPGTSESATPESGPGTSTEP<br>SEGSAPGTSESATPESGPGSPAGSPTSTEEGSPAGSPTSTEEGSPAGSPTSTEEGTSE<br>SATPESGPGTSTEPSEGSAPGTSESATPESGPGSEPATSGSETPGTSESATPESGPGS<br>EPATSGSETPGTSESATPESGPGTSTEPSEGSAPGSPAGSPTSTEEGTSESATPESGP<br>GSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSG<br>SETPGSPAGSPTSTEEGTSTEPSEGSAPGTSTEPSEGSAPGSEPATSGSETPGTSESA<br>TPESGPGTSTEPSEGSAPG (SEQ ID NO.: 938) |
| AC1359 | EpCAM | HHHHHHHHELVMTQSPSSLTVTAGEKVTMSCKSSQSLLNSGNQKNYLTWYQQKPGQPP<br>KLLIYWASTRESGVPDRFTGSGSGTDFTLTISSVQAEDLAVYYCQNDYSYPLTFGAGT<br>KLEIKGGGGSGGGGSGGGGSEVQLLEQSGAELVRPGTSVKISCKASGYAFTNYWLGWV<br>KQRPGHGLEWIGDIFPGSGNIHYNEKFKGKATLTADKSSSTAYMQLSSLTFEDSAVYF<br>CARLRNWDEPMDYWGQGTTVTVSSGGGGSEVQLVESGGGLVQPGGSLRLSCAASGYSF<br>TGYTMNWVRQAPGKGLEWVALINPYKGVSTYNQKFKDRFTISVDKSKNTAYLQMNSLR<br>AEDTAVYYCARSGYYGDSDWYFDVWGQGTLVTVSSRTSGPGDGGKGGPGKGPGGEGTK<br>GTGPGGDIQMTQSPSSLSASVGDRVTITCRASQDIRNYLNWYQQKPGKAPKLLIYYTS<br>RLESGVPSRFSGSGSGTDYTLTISSLQPEDFATYYCQQGNTLPWTFGQGTKVEIKGTA<br>EAASASGLSGRSDNHSPLGLAGSPGSPAGSPTSTEEGTSESATPESGPGTSTEPSEGS<br>APGSPAGSPTSTEEGTSTEPSEGSAPGTSTEPSEGSAPGTSESATPESGPGSEPATSG<br>SETPGSEPATSGSETPGSPAGSPTSTEEGTSESATPESGPGTSTEPSEGSAPGTSTEP<br>SEGSAPGSPAGSPTSTEEGTSTEPSEGSAPGTSTEPSEGSAPGTSESATPESGPGTST<br>EPSEGSAPGTSESATPESGPGSEPATSGSETPGTSTEPSEGSAPGTSTEPSEGSAPGT<br>SESATPESGPGTSESATPESGPGSPAGSPTSTEEGTSESATPESGPGSEPATSGSETP<br>GTSESATPESGPGTSTEPSEGSAPGTSTEPSEGSAPGTSTEPSEGSAPGTSTEPSEGS<br>APGTSTEPSEGSAPGTSTEPSEGSAPGSPAGSPTSTEEGTSTEPSEGSAPGTSESATP<br>ESGPGSEPATSGSETPGTSESATPESGPGSEPATSGSETPGTSESATPESGPGTSTEP<br>SEGSAPGTSESATPESGPGSPAGSPTSTEEGSPAGSPTSTEEGSPAGSPTSTEEGTSE<br>SATPESGPGTSTEPSEGSAPGTSESATPESGPGSEPATSGSETPGTSESATPESGPGS<br>EPATSGSETPGTSESATPESGPGTSTEPSEGSAPGSPAGSPTSTEEGTSESATPESGP<br>GSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSG<br>SETPGSPAGSPTSTEEGTSTEPSEGSAPGTSTEPSEGSAPGSEPATSGSETPGTSESA<br>TPESGPGTSTEPSEGSAPG (SEQ ID NO.: 939) |
| AC1409 | EpCAM | HHHHHHHHGTSESATPESGPGSEPATSGSETPGTSESATPESGPGSEPATSGSETPGT<br>SESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPES<br>GPGTSESATPESGPGTSESATPESGPGSEPATSGSETPGSEPATSGSETPGSPAGSPT<br>STEEGTSTEPSEGSAPGTSTEPSEGSAPGTSTEPSEGSAPGSEPATSGSETPGTSESATPESGPGTSTEP<br>SEGSAPGLSGRSDNHSPLGLAGSGTAEAASASGELVMTQSPSSLTVTAGEKVTMSCKS<br>SQSLLNSGNQKNYLTWYQQKPGQPPKLLIYWASTRESGVPDRFTGSGSGTDFTLTISS<br>VQAEDLAVYYCQNDYSYPLTFGAGTKLEIKGGGGSGGGGSGGGGSEVQLLEQSGAELV<br>RPGTSVKISCKASGYAFTNYWLGWVKQRPGHGLEWIGDIFPGSGNIHYNEKFKGKATL<br>TADKSSSTAYMQLSSLTFEDSAVYFCARLRNWDEPMDYWGQGTTVTVSSGGGGSDVQL<br>VQSGAEVKKPGASVKVSCKASGYTFTRYTMHWVRQAPGQGLEWIGYINPSRGYTNYAD<br>SVKGRFTITTDKSTSTAYMELSSLRSEDTATYYCARYYDDHYCLDYWGQGTTVTVSSG<br>EGTSTSGSGGSGGGADDIVLTQSPATLSLSPGERATLSCRASQSVSYMNWYQQKPGK<br>APKRWIYDTSKVASGVPARFSGSGSGTDYSLTINSLEAEDAATYYCQQWSSNPLTFGG<br>GTKVEIKGTAEAASASGLSGRSDNHSPLGLAGSPGSPAGSPTSTEEGTSESATPESGP<br>GTSTEPSEGSAPGSPAGSPTSTEEGTSTEPSEGSAPGTSTEPSEGSAPGTSESATPES<br>GPGSEPATSGSETPGSEPATSGSETPGSPAGSPTSTEEGTSESATPESGPGTSTEPSE<br>GSAPGTSTEPSEGSAPGSPAGSPTSTEEGTSTEPSEGSAPGTSTEPSEGSAPGTSESA<br>TPESGPGTSTEPSEGSAPGTSESATPESGPGSEPATSGSETPGTSTEPSEGSAPGTST<br>EPSEGSAPGTSESATPESGPGTSESATPESGPGSPAGSPTSTEEGTSESATPESGPGS<br>EPATSGSETPGTSESATPESGPGTSTEPSEGSAPGTSTEPSEGSAPGTSTEPSEGSAP<br>GTSTEPSEGSAPGTSTEPSEGSAPGTSTEPSEGSAPGSPAGSPTSTEEGTSTEPSEGS<br>APGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGS<br>PTSTEEGTSESATPESGPGTSTEPSEGSAPG (SEQ ID NO.: 940) |
| AC1410 | EpCAM | GSPGSPAGSPTSTEEGTSESATPESGPGTSTEPSEGSAPGSPAGSPTSTEEGTSTEPS<br>EGSAPGTSTEPSEGSAPGTSESATPESGPGSEPATSGSETPGSEPATSGSETPGSPAG<br>SPTSTEEGTSESATPESGPGTSTEPSEGSAPGTSTEPSEGSAPGSPAGSPTSTEEGTS<br>TEPSEGSAPGTSTEPSEGSAPGTSTEPSEGSAPGTSESATPESGPGS<br>EPATSGSETPGTSTEPSEGSAPGTSTEPSEGSAPGTSESATPESGPGTSESATPESG<br>PGSPAGSPTSTEEGTSESATPESGPGSEPATSGSETPGTSESATPESGPGTSTEPSEG<br>SAPGTSTEPSEGSAPGTSTEPSEGSAPGTSTEPSEGSAPGTSTEPSEGSAPGTSTEPS<br>EGSAPGSPAGSPTSTEEGTSTEPSEGSAPGTSESATPESGPGSEPATSGSETPGTSES<br>ATPESGPGSEPATSGSETPGTSESATPESGPGTSTEPSEGSAPGTSESATPESGPGSP |

TABLE 14-continued

Amino acid sequences of ProTIA constructs

| Construct ID | Tumor Targets | Amino Acid Sequences |
|---|---|---|
| | | AGSPTSTEEGSPAGSPTSTEEGSPAGSPTSTEEGTSESATPESGPGTSTEPSEGSAPG<br>TSESATPESGPGSEPATSGSETPGTSESATPESGPGSEPATSGSETPGTSESATPESG<br>PGTSTEPSEGSAPGSPAGSPTSTEEGTSESATPESGPGSEPATSGSETPGTSESATPE<br>SGPGSPAGSPTSTEEGSPAGSPTSTEEGTSTEPSEGSAPGTSESATPESGPGTSESAT<br>PESGPGTSESATPESGPGSEPATSGSETPGSEPATSGSETPGSPAGSPTSTEEGTSTE<br>PSEGSAPGTSTEPSEGSAPGSEPATSGSETPGTSESATPESGPGTSTEPSEGSAPGLS<br>GRSDNHSPLGLAGSGTAEAASASGELVMTQSPSSLTVTAGEKVTMSCKSSQSLLNSGN<br>QKNYLTWYQQKPGQPPKLLIYWASTRESGVPDRFTGSGSGTDFTLTISSVQAEDLAVY<br>YCQNDYSYPLTFGAGTKLEIKGGGGSGGGGSGGGGSEVQLLEQSGAELVRPGTSVKIS<br>CKASGYAFTNYWLGWVKQRPGHGLEWIGDIFPGSGNIHYNEKFKGKATLTADKSSSTA<br>YMQLSSLTFEDSAVYFCARLRNWDEPMDYWGQGTTVTVSSGGGGSDVQLVQSGAEVKK<br>PGASVKVSCKASGYTFTRYTMHWVRQAPGQGLEWIGYINPSRGYTNYADSVKGRFTIT<br>TDKSTSTAYMELSSLRSEDTATYYCARYYDDHYCLDYWGQGTTVTVSSGEGTSTGSGG<br>SGGSGGADDIVLTQSPATLSLSPGERATLSCRASQSVSYMNWYQQKPGKAPKRWIYDT<br>SKVASGVPARFSGSGSGTDYSLTINSLEAEDAATYYCQQWSSNPLTFGGGTKVEIKHH<br>HHHHHH (SEQ ID NO.: 941) |
| AC1411 | EpCAM | HHHHHHHHELVMTQSPSSLTVTAGEKVTMSCKSSQSLLNSGNQKNYLTWYQQKPGQPP<br>KLLIYWASTRESGVPDRFTGSGSGTDFTLTISSVQAEDLAVYYCQNDYSYPLTFGAGT<br>KLEIKGGGGSGGGGSGGGGSEVQLLEQSGAELVRPGTSVKISCKASGYAFTNYWLGWV<br>KQRPGHGLEWIGDIFPGSGNIHYNEKFKGKATLTADKSSSTAYMQLSSLTFEDSAVYF<br>CARLRNWDEPMDYWGQGTTVTVSSGGGGSDIVLTQSPATLSLSPGERATLSCRASQSV<br>SYMNWYQQKPGKAPKRWIYDTSKVASGVPARFSGSGSGTDYSLTINSLEAEDAATYYC<br>QQWSSNPLTFGGGTKVEIKGEGTSTGSGGSGGSGGADDVQLVQSGAEVKKPGASVKVS<br>CKASGYTFTRYTMHWVRQAPGQGLEWIGYINPSRGYTNYADSVKGRFTITTDKSTSTA<br>YMELSSLRSEDTATYYCARYYDDHYCLDYWGQGTTVTVSSGTAEAASASGLSGRSDNH<br>SPLGLAGSPGSPAGSPTSTEEGTSESATPESGPGTSTEPSEGSAPGSPAGSPTSTEEG<br>TSTEPSEGSAPGTSTEPSEGSAPGTSESATPESGPGSEPATSGSETPGSEPATSGSET<br>PGSPAGSPTSTEEGTSESATPESGPGTSTEPSEGSAPGTSTEPSEGSAPGSPAGSPTS<br>TEEGTSTEPSEGSAPGTSTEPSEGSAPGTSESATPESGPGTSTEPSEGSAPGTSESAT<br>PESGPGSEPATSGSETPGTSTEPSEGSAPGTSTEPSEGSAPGTSESATPESGPGTSES<br>ATPESGPGSPAGSPTSTEEGTSESATPESGPGSEPATSGSETPGTSESATPESGPGTS<br>TEPSEGSAPGTSTEPSEGSAPGTSTEPSEGSAPGTSTEPSEGSAPGTSTEPSEGSAPG<br>TSTEPSEGSAPGSPAGSPTSTEEGTSTEPSEGSAPGTSESATPESGPGSEPATSGSET<br>PGTSESATPESGPGSEPATSGSETPGTSESATPESGPGTSTEPSEGSAPGTSESATPE<br>SGPGSPAGSPTSTEEGSPAGSPTSTEEGSPAGSPTSTEEGTSESATPESGPGTSTEPS<br>EGSAPGTSESATPESGPGSEPATSGSETPGTSESATPESGPGSEPATSGSETPGTSES<br>ATPESGPGTSTEPSEGSAPGSPAGSPTSTEEGTSESATPESGPGSEPATSGSETPGTS<br>ESATPESGPGSPAGSPTSTEEGSPAGSPTSTEEGTSTEPSEGSAPGTSESATPESGPG<br>TSESATPESGPGTSESATPESGPGSEPATSGSETPGSEPATSGSETPGSPAGSPTSTE<br>EGTSTEPSEGSAPGTSTEPSEGSAPGSEPATSGSETPGTSESATPESGPGTSTEPSEG<br>SAPG (SEQ ID NO.: 942) |
| AC1412 | EpCAM | HHHHHHHHEVQLLEQSGAELVRPGTSVKISCKASGYAFTNYWLGWVKQRPGHGLEWIG<br>DIFPGSGNIHYNEKFKGKATLTADKSSSTAYMQLSSLTFEDSAVYFCARLRNWDEPMD<br>YWGQGTTVTVSSGGGGSGGGGSGGGGSELVMTQSPSSLTVTAGEKVTMSCKSSQSLLN<br>SGNQKNYLTWYQQKPGQPPKLLIYWASTRESGVPDRFTGSGSGTDFTLTISSVQAEDL<br>AVYYCQNDYSYPLTFGAGTKLEIKGGGGSDVQLVQSGAEVKKPGASVKVSCKASGYTF<br>TRYTMHWVRQAPGQGLEWIGYINPSRGYTNYADSVKGRFTITTDKSTSTAYMELSSLR<br>SEDTATYYCARYYDDHYCLDYWGQGTTVTVSSGEGTSTGSGGSGGSGGADDIVLTQSP<br>ATLSLSPGERATLSCRASQSVSYMNWYQQKPGKAPKRWIYDTSKVASGVPARFSGSGS<br>GTDYSLTINSLEAEDAATYYCQQWSSNPLTFGGGTKVEIKGTAEAASASGLSGRSDNH<br>SPLGLAGSPGSPAGSPTSTEEGTSESATPESGPGTSTEPSEGSAPGSPAGSPTSTEEG<br>TSTEPSEGSAPGTSTEPSEGSAPGTSESATPESGPGSEPATSGSETPGSEPATSGSET<br>PGSPAGSPTSTEEGTSESATPESGPGTSTEPSEGSAPGTSTEPSEGSAPGSPAGSPTS<br>TEEGTSTEPSEGSAPGTSTEPSEGSAPGTSESATPESGPGTSTEPSEGSAPGTSESAT<br>PESGPGSEPATSGSETPGTSTEPSEGSAPGTSTEPSEGSAPGTSESATPESGPGTSES<br>ATPESGPGSPAGSPTSTEEGTSESATPESGPGSEPATSGSETPGTSESATPESGPGTS<br>TEPSEGSAPGTSTEPSEGSAPGTSTEPSEGSAPGTSTEPSEGSAPGTSTEPSEGSAPG<br>TSTEPSEGSAPGSPAGSPTSTEEGTSTEPSEGSAPGTSESATPESGPGSEPATSGSET<br>PGTSESATPESGPGSEPATSGSETPGTSESATPESGPGTSTEPSEGSAPGTSESATPE<br>SGPGSPAGSPTSTEEGSPAGSPTSTEEGSPAGSPTSTEEGTSESATPESGPGTSTEPS<br>EGSAPGTSESATPESGPGSEPATSGSETPGTSESATPESGPGSEPATSGSETPGTSES<br>ATPESGPGTSTEPSEGSAPGSPAGSPTSTEEGTSESATPESGPGSEPATSGSETPGTS<br>ESATPESGPGSPAGSPTSTEEGSPAGSPTSTEEGTSTEPSEGSAPGTSESATPESGPG<br>TSESATPESGPGTSESATPESGPGSEPATSGSETPGSEPATSGSETPGSPAGSPTSTE<br>EGTSTEPSEGSAPGTSTEPSEGSAPGSEPATSGSETPGTSESATPESGPGTSTEPSEG<br>SAPG (SEQ ID NO.: 943) |
| AC1413 | EpCAM | HHHHHHHHDVQLVQSGAEVKKPGASVKVSCKASGYTFTRYTMHWVRQAPGQGLEWIGY<br>INPSRGYTNYADSVKGRFTITTDKSTSTAYMELSSLRSEDTATYYCARYYDDHYCLDY<br>WGQGTTVTVSSGEGTSTGSGGSGGSGGADDIVLTQSPATLSLSPGERATLSCRASQSV<br>SYMNWYQQKPGKAPKRWIYDTSKVASGVPARFSGSGSGTDYSLTINSLEAEDAATYYC<br>QQWSSNPLTFGGGTKVEIKGGGGSELVMTQSPSSLTVTAGEKVTMSCKSSQSLLNSGN<br>QKNYLTWYQQKPGQPPKLLIYWASTRESGVPDRFTGSGSGTDFTLTISSVQAEDLAVY |

TABLE 14-continued

Amino acid sequences of ProTIA constructs

| Construct ID | Tumor Targets | Amino Acid Sequences |
|---|---|---|
| | | YCQNDYSYPLTFGAGTKLEIKGGGGSGGGGSGGGGSEVQLLEQSGAELVRPGTSVKIS CKASGYAFTNYWLGWVKQRPGHGLEWIGDIFPGSGNIHYNEKFKGKATLTADKSSSTA YMQLSSLTFEDSAVYFCARLRNWDEPMDYWGQGTTVTVSSGTAEAASASGLSGRSDNH SPLGLAGSPGSPAGSPTSTEEGTSESATPESGPGTSTEPSEGSAPGSPAGSPTSTEEG TSTEPSEGSAPGTSTEPSEGSAPGTSESATPESGPGSEPATSGSETPGSEPATSGSET PGSPAGSPTSTEEGTSESATPESGPGTSTEPSEGSAPGTSTEPSEGSAPGSPAGSPTS TEEGTSTEPSEGSAPGTSTEPSEGSAPGTSESATPESGPGTSTEPSEGSAPGTSESAT PESGPGSEPATSGSETPGTSTEPSEGSAPGTSTEPSEGSAPGTSESATPESGPGTSES ATPESGPGSPAGSPTSTEEGTSESATPESGPGSEPATSGSETPGTSESATPESGPGTS TEPSEGSAPGTSTEPSEGSAPGTSTEPSEGSAPGTSTEPSEGSAPGTSTEPSEGSAPG TSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEPS EGSAPGTSESATPESGPGSEPATSGSETPGTSESATPESGPGSEPATSGSETPGTSES ATPESGPGTSTEPSEGSAPGSPAGSPTSTEEGTSESATPESGPGSEPATSGSETPGTS ESATPESGPGSPAGSPTSTEEGSPAGSPTSTEEGTSTEPSEGSAPGTSESATPESGPG TSESATPESGPGTSESATPESGPGSEPATSGSETPGSEPATSGSETPGSPAGSPTSTE EGTSTEPSEGSAPGTSTEPSEGSAPGSEPATSGSETPGTSESATPESGPGTSTEPSEG SAPG (SEQ ID NO.: 944) |
| AC1414 | EpCAM | HHHHHHHHDIVLTQSPATLSLSPGERATLSCRASQSVSYMNWYQQKPGKAPKRWIYDT SKVASGVPARFSGSGSGTDYSLTINSLEAEDAATYYCQQWSSNPLTFGGGTKVEIKGE GTSTGSGGSGGSGGADDVQLVQSGAEVKKPGASVKVSCKASGYTFTRYTMHWVRQAPG QGLEWIGYINPSRGYTNYADSVKGRFTITTDKSTSTAYMELSSLRSEDTATYYCARYY DDHYCLDYWGQGTTVTVSSGGGGSELVMTQSPSSLTVTAGEKVTMSCKSSQSLLNSGN QKNYLTWYQQKPGQPPKLLIYWASTRESGVPDRFTGSGSGTDFTLTISSVQAEDLAVY YCQNDYSYPLTFGAGTKLEIKGGGGSGGGGSGGGGSEVQLLEQSGAELVRPGTSVKIS CKASGYAFTNYWLGWVKQRPGHGLEWIGDIFPGSGNIHYNEKFKGKATLTADKSSSTA YMQLSSLTFEDSAVYFCARLRNWDEPMDYWGQGTTVTVSSGTAEAASASGLSGRSDNH SPLGLAGSPGSPAGSPTSTEEGTSESATPESGPGTSTEPSEGSAPGSPAGSPTSTEEG TSTEPSEGSAPGTSTEPSEGSAPGTSESATPESGPGSEPATSGSETPGSEPATSGSET PGSPAGSPTSTEEGTSESATPESGPGTSTEPSEGSAPGTSTEPSEGSAPGSPAGSPTS TEEGTSTEPSEGSAPGTSTEPSEGSAPGTSESATPESGPGTSTEPSEGSAPGTSESAT PESGPGSEPATSGSETPGTSTEPSEGSAPGTSTEPSEGSAPGTSESATPESGPGTSES ATPESGPGSPAGSPTSTEEGTSESATPESGPGSEPATSGSETPGTSESATPESGPGTS TEPSEGSAPGTSTEPSEGSAPGTSTEPSEGSAPGTSTEPSEGSAPGTSTEPSEGSAPG TSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEPS EGSAPGTSESATPESGPGSEPATSGSETPGTSESATPESGPGSEPATSGSETPGTSES ATPESGPGTSTEPSEGSAPGSPAGSPTSTEEGTSESATPESGPGSEPATSGSETPGTS ESATPESGPGSPAGSPTSTEEGSPAGSPTSTEEGTSTEPSEGSAPGTSESATPESGPG TSESATPESGPGTSESATPESGPGSEPATSGSETPGSEPATSGSETPGSPAGSPTSTE EGTSTEPSEGSAPGTSTEPSEGSAPGSEPATSGSETPGTSESATPESGPGTSTEPSEG SAPG (SEQ ID NO.: 945) |
| AC1476 | EpCAM | DIQMTQSPSSLSASVGDRVTITCRSTKSLLHSNGITYLYWYQQKPGKAPKLLIYQMSN LASGVPSRFSSSGSGTDFTLTISSLQPEDFATYYCAQNLEIPRTFGQGTKVEIKGATP PETGAETESPGETTGGSAESEPPGEGQVQLVQSGPGLVQPGGSVRISCAASGYTFTNY GMNWVKQAPGKGLEWMGWINTYTGESTYADSFKGRFTFSLDTSASAAYLQINSLRAED TAVYYCARFAIKGDYWGQGTLLTVSSGGGGSDIQMTQSPSSLSASVGDRVTITCRASQ DIRNYLNWYQQKPGKAPKLLIYYTSRLESGVPSRFSGSGSGTDYTLTISSLQPEDFAT YYCQQGNTLPWTFGQGTKVEIKGATPPETGAETESPGETTGGSAESEPPGEGQVLVE SGGGLVQPGGSLRLSCAASGYSFTGYTMNWVRQAPGKGLEWVALINPYKGVSTYNQKF KDRFTISVDKSKNTAYLQMNSLRAEDTAVYYCARSGYYGDSDWYFDVWGQGTLVTVSS GTAEAASASGLSGRSDNHSPLGLAGSPGSPAGSPTSTEEGTSESATPESGPGTSTEPS EGSAPGSPAGSPTSTEEGTSTEPSEGSAPGTSTEPSEGSAPGTSESATPESGPGSEPA TSGSETPGSEPATSGSETPGSPAGSPTSTEEGTSESATPESGPGTSTEPSEGSAPGTS TEPSEGSAPGSPAGSPTSTEEGTSTEPSEGSAPGTSTEPSEGSAPGTSESATPESGPG TSTEPSEGSAPGTSESATPESGPGSEPATSGSETPGTSTEPSEGSAPGTSTEPSEGSA PGTSESATPESGPGTSESATPESGPGSPAGSPTSTEEGTSESATPESGPGSEPATSGS ETPGTSESATPESGPGTSTEPSEGSAPGTSTEPSEGSAPGTSTEPSEGSAPGTSTEPS EGSAPGTSTEPSEGSAPGTSTEPSEGSAPGSPAGSPTSTEEGTSTEPSEGSAPGTSES ATPESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTSTEEG TSESATPESGPGTSTEPSEGSAPGTSESATPESGPGSEPATSGSETPGTSESATPESG PGSEPATSGSETPGTSESATPESGPGTSTEPSEGSAPGSPAGSPTSTEEGTSESATPE SGPGSEPATSGSETPGTSESATPESGPGSPAGSPTSTEEGSPAGSPTSTEEGTSTEPS EGSAPGTSESATPESGPGTSESATPESGPGTSESATPESGPGSEPATSGSETPGSEPA TSGSETPGSPAGSPTSTEEGTSTEPSEGSAPGTSTEPSEGSAPGSEPATSGSETPGTS ESATPESGPGTSTEPSEGSAPGHHHHHH (SEQ ID NO.: 946) |
| AC1484 | EpCAM | DIQMTQSPSSLSASVGDRVTITCRSTKSLLHSNGITYLYWYQQKPGKAPKLLIYQMSN LASGVPSRFSSSGSGTDFTLTISSLQPEDFATYYCAQNLEIPRTFGQGTKVEIKGATP PETGAETESPGETTGGSAESEPPGEGQVQLVQSGPGLVQPGGSVRISCAASGYTFTNY |

TABLE 14-continued

Amino acid sequences of ProTIA constructs

| Construct ID | Tumor Targets | Amino Acid Sequences |
|---|---|---|
| | | GMNWVKQAPGKGLEWMGWINTYTGESTYADSFKGRFTFSLDTSASAAYLQINSLRAED
TAVYYCARFAIKGDYWGQGTLLTVSSGGGGSDIQMTQSPSSLSASVGDRVTITCRASQ
DIRNYLNWYQQKPGKAPKLLIYYTSRLESGVPSRFSGSGSGTDYTLTISSLQPEDFAT
YYCQQGNTLPWTFGQGTKVEIKGATPPETGAETESPGETTGGSAESEPPGEGEVQLVE
SGGGLVQPGGSLRLSCAASGYSFTGYTMNWVRQAPGKGLEWVALINPYKGVSTYNQKF
KDRFTISVDKSKNTAYLQMNSLRAEDTAVYYCARSGYYGDSDWYFDVWGQGTLVTVSS
GSPGSPAGSPTSTEEGTSESATPESGPGTSTEPSEGSAPGSPAGSPTSTEEGTSTEPS
EGSAPGTSTEPSEGSAPGTSESATPESGPGSEPATSGSETPGSEPATSGSETPGSPAG
SPTSTEEGTSESATPESGPGTSTEPSEGSAPGTSTEPSEGSAPGSPAGSPTSTEEGTS
TEPSEGSAPGTSTEPSEGSAPGTSESATPESGPGTSTEPSEGSAPGTSESATPESGPG
SEPATSGSETPGSTSTEPSEGSAPGTSTEPSEGSAPGTSESATPESGPGTSESATPESG
PGSPAGSPTSTEEGTSESATPESGPGSEPATSGSETPGTSTEPSEGSAPGTSTEPSEG
SAPGTSTEPSEGSAPGTSTEPSEGSAPGTSTEPSEGSAPGTSTEPSEGSAPGTSTEPS
EGSAPGSPAGSPTSTEEGTSTEPSEGSAPGTSESATPESGPGSEPATSGSETPGTSES
ATPESGPGSEPATSGSETPGTSESATPESGPGTSTEPSEGSAPGTSESATPESGPGSP
AGSPTSTEEGTSPAGSPTSTEEGSPAGSPTSTEEGTSESATPESGPGTSTEPSEGSAPG
TSESATPESGPGSEPATSGSETPGTSESATPESGPGSEPATSGSETPGTSESATPESG
PGTSTEPSEGSAPGSPAGSPTSTEEGTSESATPESGPGSEPATSGSETPGTSESATPE
SGPGSPAGSPTSTEEGSPAGSPTSTEEGTSTEPSEGSAPGTSESATPESGPGTSESAT
PESGPGTSESATPESGPGSEPATSGSETPGSEPATSGSETPGSPAGSPTSTEEGTSTE
PSEGSAPGTSTEPSEGSAPGSEPATSGSETPGTSESATPESGPGTSTEPSEGSAPGHH
HHHH (SEQ ID NO.: 947) |
| AC1489 | EpCAM | DIVMTQSPLSLPVTPGEPASISCRSSKNLLHSNGITYLYWYLQKPGQSPQLLIYQMSN
LASGVPDRFSSSGSGTDFTLKISRVEAEDVGVYYCAQNLEIPRTFGQGTKVEIKGATP
PETGAETESPGETTGGSAESEPPGEGQVQLVQSGPEVKKPGASVKVSCKASGYTFTNY
GMNWVRQAPGQGLEWMGWINTYTGEPTYGEDFKGRFAFSLDTSASTAYMELSSLRSED
TAVYFCARFGNYVDYWGQGSLVTVSSGGGGSELVVTQEPSLTVSPGGTVTLTCRSSTG
AVTTSNYANWVQQKPGQAPRGLIGGTNKRAPGTPARFSGSLLGGKAALTLSGVQPEDE
AEYYCALWYSNLWVFGGGTKLTVLGATPPETGAETESPGETTGGSAESEPPGEGEVQL
LESGGGLVQPGGSLKLSCAASGFTFNTYAMNWVRQAPGKGLEWVARIRSKYNNYATYY
ADSVKDRFTISRDDSKNTAYLQMNNLKTEDTAVYYCVRHGNFGNSYVSWFAYWGQGTL
VTVSSGTAEAASASGLSGRSDNHSPLGLAGSPGSPAGSPTSTEEGTSESATPESGPGT
STEPSEGSAPGSPAGSPTSTEEGTSTEPSEGSAPGTSTEPSEGSAPGTSESATPESGP
GSEPATSGSETPGSEPATSGSETPGSPAGSPTSTEEGTSESATPESGPGTSTEPSEGS
APGTSTEPSEGSAPGSPAGSPTSTEEGTSTEPSEGSAPGTSTEPSEGSAPGTSESATP
ESGPGTSTEPSEGSAPGTSESATPESGPGSEPATSGSETPGTSTEPSEGSAPGTSTEP
SEGSAPGTSESATPESGPGTSESATPESGPGSPAGSPTSTEEGTSESATPESGPGSEP
ATSGSETPGTSESATPESGPGTSTEPSEGSAPGTSTEPSEGSAPGTSTEPSEGSAPGT
STEPSEGSAPGTSTEPSEGSAPGTSTEPSEGSAPGSPAGSPTSTEEGTSTEPSEGSAP
GTSESATPESGPGSEPATSGSETPGTSESATPESGPGSEPATSGSETPGTSESATPES
GPGTSTEPSEGSAPGTSESATPESGPGSPAGSPTSTEEGSPAGSPTSTEEGSPAGSPT
STEEGTSESATPESGPGTSTEPSEGSAPGTSESATPESGPGSEPATSGSETPGTSESA
TPESGPGSEPATSGSETPGTSESATPESGPGTSTEPSEGSAPGSPAGSPTSTEEGTSE
SATPESGPGSEPATSGSETPGTSESATPESGPGSPAGSPTSTEEGSPAGSPTSTEEGT
STEPSEGSAPGTSESATPESGPGTSESATPESGPGTSESATPESGPGSEPATSGSETP
GSEPATSGSETPGSPAGSPTSTEEGTSTEPSEGSAPGTSTEPSEGSAPGSEPATSGSE
TPGTSESATPESGPGTSTEPSEGSAPGHHHHHH (SEQ ID NO.: 948) |
| AC1490 | EpCAM | DIVMTQSPLSLPVTPGEPASISCRSSKNLLHSNGITYLYWYLQKPGQSPQLLIYQMSN
LASGVPDRFSSSGSGTDFTLKISRVEAEDVGVYYCAQNLEIPRTFGQGTKVEIKGATP
PETGAETESPGETTGGSAESEPPGEGQVQLVQSGPEVKKPGASVKVSCKASGYTFTNY
GMNWVRQAPGQGLEWMGWINTYTGEPTYGEDFKGRFAFSLDTSASTAYMELSSLRSED
TAVYFCARFGNYVDYWGQGSLVTVSSGGGGSELVVTQEPSLTVSPGGTVTLTCRSSTG
AVTTSNYANWVQQKPGQAPRGLIGGTNKRAPGTPARFSGSLLGGKAALTLSGVQPEDE
AEYYCALWYSNLWVFGGGTKLTVLGATPPETGAETESPGETTGGSAESEPPGEGEVQL
LESGGGLVQPGGSLKLSCAASGFTFNTYAMNWVRQAPGKGLEWVARIRSKYNNYATYY
ADSVKDRFTISRDDSKNTAYLQMNNLKTEDTAVYYCVRHGNFGNSYVSWFAYWGQGTL
VTVSSGSPGSPAGSPTSTEEGTSESATPESGPGTSTEPSEGSAPGSPAGSPTSTEEGT
STEPSEGSAPGTSTEPSEGSAPGTSESATPESGPGSEPATSGSETPGSEPATSGSETP
GSPAGSPTSTEEGTSESATPESGPGTSTEPSEGSAPGTSTEPSEGSAPGSPAGSPTST
EEGTSTEPSEGSAPGTSTEPSEGSAPGTSESATPESGPGTSTEPSEGSAPGTSESATP
ESGPGSEPATSGSETPGTSTEPSEGSAPGTSTEPSEGSAPGTSESATPESGPGTSESA
TPESGPGSPAGSPTSTEEGTSESATPESGPGSEPATSGSETPGTSESATPESGPGTST
EPSEGSAPGTSTEPSEGSAPGTSTEPSEGSAPGTSTEPSEGSAPGTSTEPSEGSAPGT
STEPSEGSAPGSPAGSPTSTEEGTSTEPSEGSAPGTSESATPESGPGSEPATSGSETP
GTSESATPESGPGSEPATSGSETPGTSESATPESGPGTSTEPSEGSAPGTSESATPES
GPGSPAGSPTSTEEGSPAGSPTSTEEGSPAGSPTSTEEGTSESATPESGPGTSTEPSE
GSAPGTSESATPESGPGSEPATSGSETPGTSESATPESGPGSEPATSGSETPGTSESA
TPESGPGTSTEPSEGSAPGSPAGSPTSTEEGTSESATPESGPGSEPATSGSETPGTSE
SATPESGPGSPAGSPTSTEEGSPAGSPTSTEEGTSTEPSEGSAPGTSESATPESGPGT
SESATPESGPGTSESATPESGPGSEPATSGSETPGSEPATSGSETPGSPAGSPTSTEE
GTSTEPSEGSAPGTSTEPSEGSAPGSEPATSGSETPGTSESATPESGPGTSTEPSEGS
APGHHHHHH (SEQ ID NO.: 949) |

TABLE 14-continued

Amino acid sequences of ProTIA constructs

| Construct ID | Tumor Targets | Amino Acid Sequences |
|---|---|---|
| AC1507 | EpCAM | HHHHHHGGSPAGSPTSTEEGTSESATPESGPGTSTEPSEGSAPGSPAGSPTSTEEGTS<br>TEPSEGSAPGTSTEPSEGSAPGTSESATPESGPGSEPATSGSETPGSEPATSGSETPG<br>SPAGSPTSTEEGTSESATPESGPGTSTEPSEGSAPGTSTEPSEGSAPGSPAGSPTSTE<br>EGTSTEPSEGSAPGTSTEPSEGSAPGTSESATPESGPGTSTEPSEGSAPGTSESATPE<br>SGPGSEPATSGSETPGTSTEPSEGSAPGTSTEPSEGSAPGTSESATPESGPGTSESAT<br>PESGPGSPAGSPTSTEEGTSESATPESGPGSEPATSGSETPGTSESATPESGPGTSTE<br>PSEGSAPGTSTEPSEGSAPGTSTEPSEGSAPGTSTEPSEGSAPGTSTEPSEGSAPGTS<br>TEPSEGSAPGSPAGSPTSTEEGTSTEPSEGSAPGTSESATPESGPGSEPATSGSETPG<br>TSESATPESGPGSEPATSGSETPGTSESATPESGPGTSTEPSEGSAPGTSESATPESG<br>PGSPAGSPTSTEEGSPAGSPTSTEEGSPAGSPTSTEEGTSESATPESGPGTSTEPSEG<br>SAPGTSESATPESGPGSEPATSGSETPGTSESATPESGPGSEPATSGSETPGTSESAT<br>PESGPGTSTEPSEGSAPGSPAGSPTSTEEGTSESATPESGPGSEPATSGSETPGTSES<br>ATPESGPGSPAGSPTSTEEGSPAGSPTSTEEGTSTEPSEGSAPGTSESATPESGPGTS<br>ESATPESGPGTSESATPESGPGSEPATSGSETPGSEPATSGSETPGSPAGSPTSTEEG<br>TSTEPSEGSAPGTSTEPSEGSAPGSEPATSGSETPGTSESATPESGPGTSTEPSEGSA<br>PLSGRSDNHSPLGLAGSGTAEAASASGDIQMTQSPSSLSASVGDRVTITCRASQDIRN<br>YLNWYQQKPGKAPKLLIYYTSRLESGVPSRFSGSGSGTDYTLTISSLQPEDFATYYCQ<br>QGNTLPWTFGQGTKVEIKGATPPETGAETESPGETTGGSAESEPPGEGEVQLVESGGG<br>LVQPGGSLRLSCAASGYSFTGYTMNWVRQAPGKGLEWVALINPYKGVSTYNQKFKDRF<br>TISVDKSKNTAYLQMNSLRAEDTAVYYCARSGYYGDSDWYFDVWGQGTLVTVSSGGGG<br>SDIQMTQSPSSLSASVGDRVTITCRSTKSLLHSNGITYLYWYQQKPGKAPKLLIYQMS<br>NLASGVPSRFSSSGSGTDFTLTISSLQPEDFATYYCAQNLEIPRTFGQGTKVEIKGAT<br>PPETGAETESPGETTGGSAESEPPGEGQVQLVQSGPGLVQPGGSVRISCAASGYTFTN<br>YGMNWVKQAPGKGLEWMGWINTYTGESTYADSFKGRFTFSLDTSASAAYLQINSLRAE<br>DTAVYYCARFAIKGDYWGQGTLLTVSS (SEQ ID NO.: 950) |
| AC1510 | EpCAM | HHHHHHGGSPAGSPTSTEEGTSESATPESGPGTSTEPSEGSAPGSPAGSPTSTEEGTS<br>TEPSEGSAPGTSTEPSEGSAPGTSESATPESGPGSEPATSGSETPGSEPATSGSETPG<br>SPAGSPTSTEEGTSESATPESGPGTSTEPSEGSAPGTSTEPSEGSAPGSPAGSPTSTE<br>EGTSTEPSEGSAPGTSTEPSEGSAPGTSESATPESGPGTSTEPSEGSAPGTSESATPE<br>SGPGSEPATSGSETPGTSTEPSEGSAPGTSTEPSEGSAPGTSESATPESGPGTSESAT<br>PESGPGSPAGSPTSTEEGTSESATPESGPGSEPATSGSETPGTSESATPESGPGTSTE<br>PSEGSAPGTSTEPSEGSAPGTSTEPSEGSAPGTSTEPSEGSAPGTSTEPSEGSAPGTS<br>TEPSEGSAPGSPAGSPTSTEEGTSTEPSEGSAPGTSESATPESGPGSEPATSGSETPG<br>TSESATPESGPGSEPATSGSETPGTSESATPESGPGTSTEPSEGSAPGTSESATPESG<br>PGSPAGSPTSTEEGSPAGSPTSTEEGSPAGSPTSTEEGTSESATPESGPGTSTEPSEG<br>SAPGTSESATPESGPGSEPATSGSETPGTSESATPESGPGSEPATSGSETPGTSESAT<br>PESGPGTSTEPSEGSAPGSPAGSPTSTEEGTSESATPESGPGSEPATSGSETPGTSES<br>ATPESGPGSPAGSPTSTEEGSPAGSPTSTEEGTSTEPSEGSAPGTSESATPESGPGTS<br>ESATPESGPGTSESATPESGPGSEPATSGSETPGSEPATSGSETPGSPAGSPTSTEEG<br>TSTEPSEGSAPGTSTEPSEGSAPGSEPATSGSETPGTSESATPESGPGTSTEPSEGSA<br>PGSPDIQMTQSPSSLSASVGDRVTITCRASQDIRNYLNWYQQKPGKAPKLLIYYTSRL<br>ESGVPSRFSGSGSGTDYTLTISSLQPEDFATYYCQQGNTLPWTFGQGTKVEIKGATPP<br>ETGAETESPGETTGGSAESEPPGEGEVQLVESGGGLVQPGGSLRLSCAASGYSFTGYT<br>MNWVRQAPGKGLEWVALINPYKGVSTYNQKFKDRFTISVDKSKNTAYLQMNSLRAEDT<br>AVYYCARSGYYGDSDWYFDVWGQGTLVTVSSGGGGSDIQMTQSPSSLSASVGDRVTIT<br>CRSTKSLLHSNGITYLYWYQQKPGKAPKLLIYQMSNLASGVPSRFSSSGSGTDFTLTI<br>SSLQPEDFATYYCAQNLEIPRTFGQGTKVEIKGATPPETGAETESPGETTGGSAESEP<br>PGEGQVQLVQSGPGLVQPGGSVRISCAASGYTFTNYGMNWVKQAPGKGLEWMGWINTY<br>TGESTYADSFKGRFTFSLDTSASAAYLQINSLRAEDTAVYYCARFAIKGDYWGQGTLL<br>TVSS (SEQ ID NO.: 951) |
| AC1501 | HER2 | DIQMTQSPSSLSASVGDRVTITCRASQDVNTAVAWYQQKPGKAPKLLIYSASFLYSGV<br>PSRFSGSRSGTDFTLTISSLQPEDFATYYCQQHYTTPPTFGQGTKVEIKGATPPETGA<br>ETESPGETTGGSAESEPPGEGEVQLVESGGGLVQPGGSLRLSCAASGFNIKDTYIHWV<br>RQAPGKGLEWVARIYPTNGYTRYADSVKGRFTISADTSKNTAYLQMNSLRAEDTAVYY<br>CSRWGGDGFYAMDYWGQGTLVTVSSGGGGSDIQMTQSPSSLSASVGDRVTITCRASQD<br>IRNYLNWYQQKPGKAPKLLIYYTSRLESGVPSRFSGSGSGTDYTLTISSLQPEDFATY<br>YCQQGNTLPWTFGQGTKVEIKGATPPETGAETESPGETTGGSAESEPPGEGEVQLVES<br>GGGLVQPGGSLRLSCAASGYSFTGYTMNWVRQAPGKGLEWVALINPYKGVSTYNQKFK<br>DRFTISVDKSKNTAYLQMNSLRAEDTAVYYCARSGYYGDSDWYFDVWGQGTLVTVSSG<br>TAEAASASGLSGRSDNHSPLGLAGSPGSPAGSPTSTEEGTSESATPESGPGTSTEPSE<br>GSAPGSPAGSPTSTEEGTSTEPSEGSAPGTSTEPSEGSAPGTSESATPESGPGSEPAT<br>SGSETPGSEPATSGSETPGSPAGSPTSTEEGTSESATPESGPGTSTEPSEGSAPGTST<br>EPSEGSAPGSPAGSPTSTEEGTSTEPSEGSAPGTSTEPSEGSAPGTSESATPESGPGT<br>STEPSEGSAPGTSESATPESGPGSEPATSGSETPGTSTEPSEGSAPGTSTEPSEGSAP<br>GTSESATPESGPGTSESATPESGPGSPAGSPTSTEEGTSESATPESGPGSEPATSGSE<br>TPGTSESATPESGPGTSTEPSEGSAPGTSTEPSEGSAPGTSTEPSEGSAPGTSTEPSE<br>GSAPGTSTEPSEGSAPGTSTEPSEGSAPGSPAGSPTSTEEGTSTEPSEGSAPGTSESA<br>TPESGPGSEPATSGSETPGTSESATPESGPGSPAGSPTSTEEGSPAGSPTSTEEGTST<br>EPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATSGSETPGTSESATPESGP<br>GSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSE<br>GSAPGTSESATPESGPGTSESATPESGPGTSESATPESGPGSEPATSGSETPGSEPAT |

TABLE 14-continued

Amino acid sequences of ProTIA constructs

| Construct ID | Tumor Targets | Amino Acid Sequences |
|---|---|---|
| | | SGSETPGSPAGSPTSTEEGTSTEPSEGSAPGTSTEPSEGSAPGSEPATSGSETPGTSE<br>SATPESGPGTSTEPSEGSAPGHHHHHH (SEQ ID NO.: 952) |
| AC1502 | HER2 | DIQMTQSPSSLSASVGDRVTITCRASQDVNTAVAWYQQKPGKAPKLLIYSASFLYSGV<br>PSRFSGSRSGTDFTLTISSLQPEDFATYYCQQHYTTPPTFGQGTKVEIKGATPPETGA<br>ETESPGETTGGSAESEPPGEGEVQLVESGGGLVQPGGSLRLSCAASGFNIKDTYIHWV<br>RQAPGKGLEWVARIYPTNGYTRYADSVKGRFTISADTSKNTAYLQMNSLRAEDTAVYY<br>CSRWGGDGFYAMDYWGQGTLVTVSSGGGGSDIQMTQSPSSLSASVGDRVTITCRASQD<br>IRNYLNWYQQKPGKAPKLLIYYTSRLESGVPSRFSGSGSGTDYTLTISSLQPEDFATY<br>YCQQGNTLPWTFGQGTKVEIKGATPPETGAETESPGETTGGSAESEPPGEGEVQLVES<br>GGGLVQPGGSLRLSCAASGYSFTGYTMNWVRQAPGKGLEWVALINPYKGVSTYNQKFK<br>DRFTISVDKSKNTAYLQMNSLRAEDTAVYYCARSGYYGDSDWYFDVWGQGTLVTVSSG<br>SPGSPAGSPTSTEEGTSESATPESGPGTSTEPSEGSAPGSPAGSPTSTEEGTSTEPSE<br>GSAPGTSTEPSEGSAPGTSESATPESGPGSEPATSGSETPGSEPATSGSETPGSPAGS<br>PTSTEEGTSESATPESGPGTSTEPSEGSAPGTSTEPSEGSAPGSPAGSPTSTEEGTST<br>EPSEGSAPGTSTEPSEGSAPGTSESATPESGPGTSTEPSEGSAPGTSESATPESGPGS<br>EPATSGSETPGTSTEPSEGSAPGTSTEPSEGSAPGTSESATPESGPGTSESATPESGP<br>GSPAGSPTSTEEGTSESATPESGPGSEPATSGSETPGTSESATPESGPGTSTEPSEGS<br>APGTSTEPSEGSAPGTSTEPSEGSAPGTSTEPSEGSAPGTSTEPSEGSAPGTSTEPSE<br>GSAPGSPAGSPTSTEEGTSTEPSEGSAPGSEPATSGSETPGTSESA<br>TPESGPGSEPATSGSETPGTSESATPESGPGTSTEPSEGSAPGTSESATPESGPGSPA<br>GSPTSTEEGSPAGSPTSTEEGSPAGSPTSTEEGTSESATPESGPGTSTEPSEGSAPGT<br>SESATPESGPGSEPATSGSETPGTSESATPESGPGSEPATSGSETPGTSESATPESGP<br>GTSTEPSEGSAPGSPAGSPTSTEEGTSESATPESGPGSEPATSGSETPGTSESATPES<br>GPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEP<br>SEGSAPGTSTEPSEGSAPGSEPATSGSETPGTSESATPESGPGTSTEPSEGSAPGHHH<br>HHH (SEQ ID NO.: 953) |
| AC1503 | HER2 | DIQMTQSPSSLSASVGDRVTITCRASQDVNTAVAWYQQKPGKAPKLLIYSASFLYSGV<br>PSRFSGSRSGTDFTLTISSLQPEDFATYYCQQHYTTPPTFGQGTKVEIKGATPPETGA<br>ETESPGETTGGSAESEPPGEGEVQLVESGGGLVQPGGSLRLSCAASGFNIKDTYTHWV<br>RQAPGKGLEWVARTYPTNGYTRYADSVKGRFTISADTSKNTAYLQMNSLRAEDTAVYY<br>CSRWGGDGFYAMDYWGQGTLVTVSSGGGGSELVVTQEPSLTVSPGGTVTLTCRSSTGA<br>VTTSNYANWVQQKPGQAPRGLIGGTNKRAPGTPARFSGSLLGGKAALTLSGVQPEDEA<br>EYYCALWYSNLWVFGGGTKLTVLGATPPETGAETESPGETTGGSAESEPPGEGEVQLL<br>ESGGGLVQPGGSLKLSCAASGFTFNTYAMNWVRQAPGKGLEWVARIRSKYNNYATYYA<br>DSVKDRFTISRDDSKNTAYLQMNNLKTEDTAVYYCVRHGNFGNSYVSWFAYWGQGTLV<br>TVSSGTAEAASASGLSGRSDNHSPLGLAGSPGSPAGSPTSTEEGTSESATPESGPGTS<br>TEPSEGSAPGSPAGSPTSTEEGTSTEPSEGSAPGTSTEPSEGSAPGTSESATPESGPG<br>SEPATSGSETPGSEPATSGSETPGSPAGSPTSTEEGTSESATPESGPGTSTEPSEGSA<br>PGTSTEPSEGSAPGSPAGSPTSTEEGTSTEPSEGSAPGTSTEPSEGSAPGTSESATPE<br>SGPGTSTEPSEGSAPGTSESATPESGPGSEPATSGSETPGTSTEPSEGSAPGTSTEPS<br>EGSAPGTSESATPESGPGTSESATPESGPGSPAGSPTSTEEGTSESATPESGPGSEPA<br>TSGGSETPGTSESATPESGPGTSTEPSEGSAPGTSTEPSEGSAPGTSTEPSEGSAPGTS<br>TEPSEGSAPGTSTEPSEGSAPGTSTEPSEGSAPGSPAGSPTSTEEGTSTEPSEGSAPG<br>TSESATPESGPGSEPATSGSETPGTSESATPESGPGSEPATSGSETPGTSESATPESG<br>PGTSTEPSEGSAPGTSESATPESGPGSPAGSPTSTEEGSPAGSPTSTEEGSPAGSPTS<br>TEEGTSESATPESGPGTSTEPSEGSAPGTSESATPESGPGSEPATSGSETPGTSESAT<br>PESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTS<br>TEPSEGSAPGTSESATPESGPGTSESATPESGPGTSESATPESGPGSEPATSGSETPG<br>SEPATSGSETPGSPAGSPTSTEEGTSTEPSEGSAPGTSTEPSEGSAPGSEPATSGSET<br>PGTSESATPESGPGTSTEPSEGSAPGHHHHHH (SEQ ID NO.: 954) |
| AC1504 | HER2 | DIQMTQSPSSLSASVGDRVTITCRASQDVNTAVAWYQQKPGKAPKLLIYSASFLYSGV<br>PSRFSGSRSGTDFTLTISSLQPEDFATYYCQQHYTTPPTFGQGTKVEIKGATPPETGA<br>ETESPGETTGGSAESEPPGEGEVQLVESGGGLVQPGGSLRLSCAASGFNIKDTYTHWV<br>RQAPGKGLEWVARTYPTNGYTRYADSVKGRFTISADTSKNTAYLQMNSLRAEDTAVYY<br>CSRWGGDGFYAMDYWGQGTLVTVSSGGGGSELVVTQEPSLTVSPGGTVTLTCRSSTGA<br>VTTSNYANWVQQKPGQAPRGLIGGTNKRAPGTPARFSGSLLGGKAALTLSGVQPEDEA<br>EYYCALWYSNLWVFGGGTKLTVLGATPPETGAETESPGETTGGSAESEPPGEGEVQLL<br>ESGGGLVQPGGSLKLSCAASGFTFNTYAMNWVRQAPGKGLEWVARIRSKYNNYATYYA<br>DSVKDRFTISRDDSKNTAYLQMNNLKTEDTAVYYCVRHGNFGNSYVSWFAYWGQGTLV<br>TVSSGSPGSPAGSPTSTEEGTSESATPESGPGTSTEPSEGSAPGSPAGSPTSTEEGTS<br>TEPSEGSAPGTSTEPSEGSAPGTSESATPESGPGSEPATSGSETPGSEPATSGSETPG<br>SPAGSPTSTEEGTSESATPESGPGTSTEPSEGSAPGTSTEPSEGSAPGSPAGSPTSTE<br>EGTSTEPSEGSAPGTSTEPSEGSAPGTSESATPESGPGTSTEPSEGSAPGTSESATPE<br>SGPGSEPATSGSETPGTSTEPSEGSAPGTSTEPSEGSAPGTSESATPESGPGTSESAT<br>PESGPGSPAGSPTSTEEGTSESATPESGPGSEPATSGSETPGTSE<br>PSEGSAPGTSTEPSEGSAPGTSTEPSEGSAPGTSTEPSEGSAPGTSTEPSEGSAPGTS<br>TEPSEGSAPGSPAGSPTSTEEGTSTEPSEGSAPGTSESATPESGPGSEPATSGSETPG<br>TSESATPESGPGSEPATSGSETPGTSESATPESGPGTSTEPSEGSAPGTSESATPESG<br>PGSPAGSPTSTEEGSPAGSPTSTEEGSPAGSPTSTEEGTSESATPESGPGTSTEPSEG<br>SAPGTSESATPESGPGSEPATSGSETPGTSESATPESGPGSEPATSGSETPGTSESAT |

TABLE 14-continued

Amino acid sequences of ProTIA constructs

| Construct ID | Tumor Targets | Amino Acid Sequences |
|---|---|---|
| | | PESGPGTSTEPSEGSAPGSPAGSPTSTEEGTSESATPESGPGSEPATSGSETPGTSES<br>ATPESGPGSPAGSPTSTEEGSPAGSPTSTEEGTSTEPSEGSAPGTSESATPESGPGTS<br>ESATPESGPGTSESATPESGPGSEPATSGSETPGSEPATSGSETPGSPAGSPTSTEEG<br>TSTEPSEGSAPGTSTEPSEGSAPGSEPATSGSETPGTSESATPESGPGTSTEPSEGSA<br>PGHHHHHH (SEQ ID NO.: 955) |
| AC1505 | HER2 | DIQMTQSPSSLSASVGDRVTITCKASQDVSIGVAWYQQKPGKAPKLLIYSASYRYTGV<br>PSRFSGSGSGTDFTLTISSLQPEDFATYYCQQYYTYPYTFGQGTKVEIKGATPPETGA<br>ETESPGETTGGSAESEPPGEGEVQLVESGGGLVQPGGSLRLSCAASGFTFTDYTMDWV<br>RQAPGKGLEWVADVNPNSGGSTYNQRFKGRFTLSVDRSKNTLYLQMNSLRAEDTAVYY<br>CARNLGPSFYFDYWGQGTLVTVSSGGGGSDIQMTQSPSSLSASVGDRVTITCRASQDI<br>RNYLNWYQQKPGKAPKLLIYYTSRLESGVPSRFSGSGSGTDYTLTISSLQPEDFATYY<br>CQQGNTLPWTFGQGTKVEIKGATPPETGAETESPGETTGGSAESEPPGEGEVQLVESG<br>GGLVQPGGSLRLSCAASGYSFTGYTMNWVRQAPGKGLEWVALINPYKGVSTYNQKFKD<br>RFTISVDKSKNTAYLQMNSLRAEDTAVYYCARSGYYGDSDWYFDVWGQGTLVTVSSGT<br>AEAASASGLSGRSDNHSPLGLAGSPGSPAGSPTSTEEGTSESATPESGPGTSTEPSEG<br>SAPGSPAGSPTSTEEGTSTEPSEGSAPGTSTEPSEGSAPGTSESATPESGPGSEPATS<br>GSETPGSEPATSGSETPGSPAGSPTSTEEGTSESATPESGPGTSTEPSEGSAPGTSTE<br>PSEGSAPGSPAGSPTSTEEGTSTEPSEGSAPGTSTEPSEGSAPGTSESATPESGPGTS<br>TEPSEGSAPGTSESATPESGPGSEPATSGSETPGTSTEPSEGSAPGTSTEPSEGSAPG<br>TSESATPESGPGTSESATPESGPGSPAGSPTSTEEGTSESATPESGPGSEPATSGSET<br>PGTSESATPESGPGTSTEPSEGSAPGTSTEPSEGSAPGTSTEPSEGSAPGTSTEPSEG<br>SAPGTSTEPSEGSAPGTSTEPSEGSAPGSPAGSPTSTEEGTSTEPSEGSAPGTSESAT<br>PESGPGSEPATSGSETPGTSESATPESGPGSPAGSPTSTEEGSPAGSPTSTEEGTSTE<br>PSEGSAPGTSESATPESGPGSPAGSPTSTEEGSPAGSPTSTEEGTS<br>ESATPESGPGTSTEPSEGSAPGTSESATPESGPGSEPATSGSETPGTSESATPESGPG<br>SEPATSGSETPGTSESATPESGPGTSTEPSEGSAPGSPAGSPTSTEEGTSESATPESG<br>PGSEPATSGSETPGTSESATPESGPGSPAGSPTSTEEGSPAGSPTSTEEGTSTEPSEG<br>SAPGTSESATPESGPGTSESATPESGPGTSESATPESGPGSEPATSGSETPGSEPATS<br>GSETPGSPAGSPTSTEEGTSTEPSEGSAPGTSTEPSEGSAPGSEPATSGSETPGTSES<br>ATPESGPGTSTEPSEGSAPGHHHHHH (SEQ ID NO.: 956) |
| AC1506 | HER2 | DIQMTQSPSSLSASVGDRVTITCKASQDVSIGVAWYQQKPGKAPKLLIYSASYRYTGV<br>PSRFSGSGSGTDFTLTISSLQPEDFATYYCQQYYTYPYTFGQGTKVEIKGATPPETGA<br>ETESPGETTGGSAESEPPGEGEVQLVESGGGLVQPGGSLRLSCAASGFTFTDYTMDWV<br>RQAPGKGLEWVADVNPNSGGSTYNQRFKGRFTLSVDRSKNTLYLQMNSLRAEDTAVYY<br>CARNLGPSFYFDYWGQGTLVTVSSGGGGSDIQMTQSPSSLSASVGDRVTITCRASQDI<br>RNYLNWYQQKPGKAPKLLIYYTSRLESGVPSRFSGSGSGTDYTLTISSLQPEDFATYY<br>CQQGNTLPWTFGQGTKVEIKGATPPETGAETESPGETTGGSAESEPPGEGEVQLVESG<br>GGLVQPGGSLRLSCAASGYSFTGYTMNWVRQAPGKGLEWVALINPYKGVSTYNQKFKD<br>RFTISVDKSKNTAYLQMNSLRAEDTAVYYCARSGYYGDSDWYFDVWGQGTLVTVSSGS<br>PGSPAGSPTSTEEGTSESATPESGPGTSTEPSEGSAPGSPAGSPTSTEEGTSTEPSEG<br>SAPGTSTEPSEGSAPGTSESATPESGPGSEPATSGSETPGSEPATSGSETPGSPAGSP<br>TSTEEGTSESATPESGPGTSTEPSEGSAPGTSTEPSEGSAPGSPAGSPTSTEEGTSTE<br>PSEGSAPGTSTEPSEGSAPGTSESATPESGPGTSTEPSEGSAPGTSESATPESGPGSE<br>PATSGSETPGTSTEPSEGSAPGTSTEPSEGSAPGTSESATPESGPGTSESATPESGPG<br>SPAGSPTSTEEGTSESATPESGPGSEPATSGSETPGTSESATPESGPGTSTEPSEGSA<br>PGTSTEPSEGSAPGTSTEPSEGSAPGTSTEPSEGSAPGTSTEPSEGSAPGTSTEPSEG<br>SAPGSPAGSPTSTEEGTSTEPSEGSAPGTSESATPESGPGSEPATSGSETPGTSESAT<br>PESGPGSEPATSGSETPGTSESATPESGPGTSTEPSEGSAPGTSESATPESGPGSPAG<br>SPTSTEEGSPAGSPTSTEEGSPAGSPTSTEEGTSESATPESGPGTSTEPSEGSAPGTS<br>ESATPESGPGSEPATSGSETPGTSESATPESGPGSEPATSGSETPGTSESATPESGPG<br>TSTEPSEGSAPGSPAGSPTSTEEGTSESATPESGPGSEPATSGSETPGTSESATPESG<br>PGSPAGSPTSTEEGSPAGSPTSTEEGTSTEPSEGSAPGTSESATPESGPGTSESATPE<br>SGPGTSESATPESGPGSEPATSGSETPGSEPATSGSETPGSPAGSPTSTEEGTSTEPS<br>EGSAPGTSTEPSEGSAPGSEPATSGSETPGTSESATPESGPGTSTEPSEGSAPGHHHH<br>HH (SEQ ID NO.: 957) |
| AC1518 | HER2 | DIQMTQSPSSLSASVGDRVTITCKASQDVSIGVAWYQQKPGKAPKLLIYSASYRYTGV<br>PSRFSGSGSGTDFTLTISSLQPEDFATYYCQQYYTYPYTFGQGTKVEIKGATPPETGA<br>ETESPGETTGGSAESEPPGEGEVQLVESGGGLVQPGGSLRLSCAASGFTFTDYTMDWV<br>RQAPGKGLEWVADVNPNSGGSIYNQRFKGRFTLSVDRSKNTLYLQMNSLRAEDTAVYY<br>CARNLGPSFYFDYWGQGTLVTVSSGGGGSELVVTQEPSLTVSPGGTVTLTCRSSTGAV<br>TTSNYANWVQQKPGQAPRGLIGGTNKRAPGTPARFSGSLLGGKAALTLSGVQPEDEAE<br>YYCALWYSNLWVFGGGTKLTVLGATPPETGAETESPGETTGGSAESEPPGEGEVQLLE<br>SGGGLVQPGGSLKLSCAASGFTFNTYAMNWVRQAPGKGLEWVARIRSKYNNYATYYAD<br>SVKDRFTISRDDSKNTAYLQMNNLKTEDTAVYYCVRHGNFGNSYVSWFAYWGQGTLVT<br>VSSGTAEAASASGLSGRSDNHSPLGLAGSPGSPAGSPTSTEEGTSESATPESGPGTST<br>EPSEGSAPGSPAGSPTSTEEGTSTEPSEGSAPGTSTEPSEGSAPGTSESATPESGPGS<br>EPATSGSETPGSEPATSGSETPGSPAGSPTSTEEGTSESATPESGPGTSTEPSEGSAP<br>GTSTEPSEGSAPGSPAGSPTSTEEGTSTEPSEGSAPGTSTEPSEGSAPGTSESATPES<br>GPGTSTEPSEGSAPGTSESATPESGPGSEPATSGSETPGTSTEPSEGSAPGTSTEPSE<br>GSAPGTSESATPESGPGTSESATPESGPGSPAGSPTSTEEGTSESATPESGPGSEPAT<br>SGSETPGTSESATPESGPGTSTEPSEGSAPGTSTEPSEGSAPGTSTEPSEGSAPGTST<br>EPSEGSAPGTSTEPSEGSAPGTSTEPSEGSAPGSPAGSPTSTEEGTSTEPSEGSAPGT |

TABLE 14-continued

Amino acid sequences of ProTIA constructs

| Construct ID | Tumor Targets | Amino Acid Sequences |
|---|---|---|
| | | SESATPESGPGSEPATSGSETPGTSESATPESGPGSEPATSGSETPGTSESATPESGP<br>GTSTEPSEGSAPGTSESATPESGPGSPAGSPTSTEEGSPAGSPTSTEEGSPAGSPTST<br>EEGTSESATPESGPGTSTEPSEGSAPGTSESATPESGPGSEPATSGSETPGTSESATP<br>ESGPGSEPATSGSETPGTSESATPESGPGTSTEPSEGSAPGSPAGSPTSTEEGTSESA<br>TPESGPGSEPATSGSETPGTSESATPESGPGSPAGSPTSTEEGSPAGSPTSTEEGTST<br>EPSEGSAPGTSESATPESGPGTSESATPESGPGTSESATPESGPGSEPATSGSETPGS<br>EPATSGSETPGSPAGSPTSTEEGTSTEPSEGSAPGTSTEPSEGSAPGSEPATSGSETP<br>GTSESATPESGPGTSTEPSEGSAPGHHHHHH (SEQ ID NO.: 958) |
| AC1519 | HER2 | DIQMTQSPSSLSASVGDRVTITCKASQDVSIGVAWYQQKPGKAPKLLIYSASYRYTGV<br>PSRFSGSGSGTDFTLTISSLQPEDFATYYCQQYYIYPYTFGQGTKVEIKGATPPETGA<br>ETESPGETTGGSAESEPPGEGEVQLVESGGGLVQPGGSLRLSCAASGFTFTDYTMDWV<br>RQAPGKGLEWVADVNPNSGGSIYNQRFKGRFTLSVDRSKNTLYLQMNSLRAEDTAVYY<br>CARNLGPSFYFDYWGQGTLVTVSSGGGGSELVVTQEPSLTVSPGGTVTLTCRSSTGAV<br>TTSNYANWVQQKPGQAPRGLIGGTNKRAPGTPARFSGSLLGGKAALTLSGVQPEDEAE<br>YYCALWYSNLWVFGGGTKLTVLGATPPETGAETESPGETTGGSAESEPPGEGEVQLLE<br>SGGGLVQPGGSLKLSCAASGFTFNTYAMNWVRQAPGKGLEWVARIRSKYNNYATYYAD<br>SVKDRFTISRDDSKNTAYLQMNNLKTEDTAVYYCVRHGNFGNSYVSWFAYWGQGTLVT<br>VSSGSPGSPAGSPTSTEEGTSESATPESGPGTSTEPSEGSAPGSPAGSPTSTEEGTST<br>EPSEGSAPGTSTEPSEGSAPGTSESATPESGPGSEPATSGSETPGSEPATSGSETPGS<br>PAGSPTSTEEGTSESATPESGPGTSTEPSEGSAPGTSTEPSEGSAPGSPAGSPTSTEE<br>GTSTEPSEGSAPGTSTEPSEGSAPGTSESATPESGPGTSTEPSEGSAPGTSESATPES<br>GPGSEPATSGSETPGTSTEPSEGSAPGTSTEPSEGSAPGTSESATPESGPGTSESATP<br>ESGPGSPAGSPTSTEEGTSESATPESGPGSEPATSGSETPGTSESATPESGPGTSTEP<br>SEGSAPGTSTEPSEGSAPGTSTEPSEGSAPGTSTEPSEGSAPGTSTEPSEGSAPGTST<br>EPSEGSAPGSPAGSPTSTEEGTSTEPSEGSAPGTSESATPESGPGSEPATSGSETPGT<br>SESATPESGPGSEPATSGSETPGTSESATPESGPGTSTEPSEGSAPGTSESATPESGP<br>GSPAGSPTSTEEGSPAGSPTSTEEGTSESATPESGPGTSTEPSEGS<br>APGTSESATPESGPGSEPATSGSETPGTSESATPESGPGSEPATSGSETPGTSESATP<br>ESGPGTSTEPSEGSAPGSPAGSPTSTEEGTSESATPESGPGSEPATSGSETPGTSESA<br>TPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGT<br>STEPSEGSAPGTSTEPSEGSAPGSEPATSGSETPGTSESATPESGPGTSTEPSEGSAP<br>GHHHHHH (SEQ ID NO.: 959) |
| AC1521 | CEA | DIQLTQSPSSLSASVGDRVTITCKASQDVGTSVAWYQQKPGKAPKLLIYWTSTRHTGV<br>PSRFSGSGSGTDFTFTISSLQPEDIATYYCQQYSLYRSFGQGTKVEIKGATPPETGAE<br>TESPGETTGGSAESEPPGEGEVQLVESGGGVVQPGRSLRLSCSASGFDFTTYWMSWVR<br>QAPGKGLEWIGEIHPDSSTINYAPSLKDRFTISRDNAKNTLFLQMDSLRPEDTGVYFC<br>ASLYFGFPWFAYWGQGTPVTVSSGGGGSDIQMTQSPSSLSASVGDRVTITCRASQDIR<br>NYLNWYQQKPGKAPKLLIYYTSRLESGVPSRFSGSGSGTDYTLTISSLQPEDFATYYC<br>QQGNTLPWTFGQGTKVEIKGATPPETGAETESPGETTGGSAESEPPGEGEVQLVESGG<br>GLVQPGGSLRLSCAASGYSFTGYTMNWVRQAPGKGLEWVALINPYKGVSTYNQKFKDR<br>FTISVDKSKNTAYLQMNSLRAEDTAVYYCARSGYYGDSDWYFDVWGQGTLVTVSSGTA<br>EAASASGLSGRSDNHSPLGLAGSPGSPAGSPTSTEEGTSESATPESGPGTSTEPSEGS<br>APGSPAGSPTSTEEGTSTEPSEGSAPGTSTEPSEGSAPGTSESATPESGPGSEPATSG<br>SETPGSEPATSGSETPGSPAGSPTSTEEGTSESATPESGPGTSTEPSEGSAPGTSTEP<br>SEGSAPGSPAGSPTSTEEGTSTEPSEGSAPGTSTEPSEGSAPGTSESATPESGPGTST<br>EPSEGSAPGTSESATPESGPGSEPATSGSETPGTSTEPSEGSAPGTSTEPSEGSAPGT<br>SESATPESGPGTSESATPESGPGSPAGSPTSTEEGTSESATPESGPGSEPATSGSETP<br>GTSESATPESGPGTSTEPSEGSAPGTSTEPSEGSAPGTSTEPSEGSAPGTSTEPSEGS<br>APGTSTEPSEGSAPGTSTEPSEGSAPGSPAGSPTSTEEGTSTEPSEGSAPGTSESATP<br>ESGPGSEPATSGSETPGTSESATPESGPGSEPATSGSETPGTSESATPESGPGTSTEP<br>SEGSAPGTSESATPESGPGSPAGSPTSTEEGSPAGSPTSTEEGSPAGSPTSTEEGTSE<br>SATPESGPGTSTEPSEGSAPGTSESATPESGPGSEPATSGSETPGTSESATPESGPGS<br>EPATSGSETPGTSESATPESGPGTSTEPSEGSAPGSPAGSPTSTEEGTSESATPESGP<br>GSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSG<br>SETPGSPAGSPTSTEEGTSTEPSEGSAPGTSTEPSEGSAPGSEPATSGSETPGTSESA<br>TPESGPGTSTEPSEGSAPGHHHHHH (SEQ ID NO.: 960) |
| AC1523 | CEA | DIQLTQSPSSLSASVGDRVTITCKASQDVGTSVAWYQQKPGKAPKLLIYWTSTRHTGV<br>PSRFSGSGSGTDFTFTISSLQPEDIATYYCQQYSLYRSFGQGTKVEIKGATPPETGAE<br>TESPGETTGGSAESEPPGEGEVQLVESGGGVVQPGRSLRLSCSASGFDFTTYWMSWVR<br>QAPGKGLEWIGEIHPDSSTINYAPSLKDRFTISRDNAKNTLFLQMDSLRPEDTGVYFC<br>ASLYFGFPWFAYWGQGTPVTVSSGGGGSDIQMTQSPSSLSASVGDRVTITCRASQDIR<br>NYLNWYQQKPGKAPKLLIYYTSRLESGVPSRFSGSGSGTDYTLTISSLQPEDFATYYC<br>QQGNTLPWTFGQGTKVEIKGATPPETGAETESPGETTGGSAESEPPGEGEVQLVESGG<br>GLVQPGGSLRLSCAASGYSFTGYTMNWVRQAPGKGLEWVALINPYKGVSTYNQKFKDR<br>FTISVDKSKNTAYLQMNSLRAEDTAVYYCARSGYYGDSDWYFDVWGQGTLVTVSSGSP<br>GSPAGSPTSTEEGTSESATPESGPGTSTEPSEGSAPGSPAGSPTSTEEGTSTEPSEGS<br>APGTSTEPSEGSAPGTSESATPESGPGSEPATSGSETPGSEPATSGSETPGSPAGSPT<br>STEEGTSESATPESGPGTSTEPSEGSAPGTSTEPSEGSAPGSPAGSPTSTEEGTSTEP<br>SEGSAPGTSTEPSEGSAPGTSESATPESGPGTSTEPSEGSAPGTSESATPESGPGSEP<br>ATSGSETPGTSTEPSEGSAPGTSTEPSEGSAPGTSESATPESGPGTSESATPESGPGS |

TABLE 14-continued

Amino acid sequences of ProTIA constructs

| Construct ID | Tumor Targets | Amino Acid Sequences |
|---|---|---|
| | | PAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGS APGSPAGSPTSTEEGTSTEPSEGSAPGTSESATPESGPGSEPATSGSETPGTSESATP ESGPGSEPATSGSETPGTSESATPESGPGTSTEPSEGSAPGTSESATPESGPSPAGS PTSTEEGSPAGSPTSTEEGSPAGSPTSTEEGTSESATPESGPGTSTEPSEGSAPGTSE SATPESGPGSEPATSGSETPGTSESATPESGPGSEPATSGSETPGTSESATPESGPGT STEPSEGSAPGSPAGSPTSTEEGTSESATPESGPGSEPATSGSETPGTSESATPESGP GSPAGSPTSTEEGSPAGSPTSTEEGTSTEPSEGSAPGTSESATPESGPGTSESATPES GPGTSESATPESGPGSEPATSGSETPGSEPATSGSETPGSPAGSPTSTEEGTSTEPSE GSAPGTSTEPSEGSAPGSEPATSGSETPGTSESATPESGPGTSTEPSEGSAPGHHHHH H (SEQ ID NO.: 961) |
| AC1522 | PS | DIQMTQSPSSLSTSVGDRVTLTCKASQDVGTAVDWYQQKPGPSPKLLIYWASTRHTGI PSRFSGSGSGTDFTLTISSLQPEDFADYYCQQYNSYPLTFGPGTKVDIKGATPPETGA ETESPGETTGGSAESEPPGEGEVQLVQSGPEVKKPGATVKISCKTSGYTFTEYTIHWV KQAPGKGLEWIGNINPNNGGTTYNQKFEDKATLTVDKSTDTAYMELSSLRSEDTAVYY CAAGWNFDYWGQGTLLTVSSGGGGSDIQMTQSPSSLSASVGDRVTITCRASQDIRNYL NWYQQKPGKAPKLLIYYTSRLESGVPSRFSGSGSGTDYTLTISSLQPEDFATYYCQQG NTLPWTFGQGTKVEIKGATPPETGAETESPGETTGGSAESEPPGEGEVQLVESGGGLV QPGGSLRLSCAASGYSFTGYTMNWVRQAPGKGLEWVALINPYKGVSTYNQKFKDRFTI SVDKSKNTAYLQMNSLRAEDTAVYYCARSGYYGDSDWYFDVWGQGTLVTVSSGTAEAA SASGLSGRSDNHSPLGLAGSPGSPAGSPTSTEEGTSESATPESGPGTSTEPSEGSAPG SPAGSPTSTEEGTSTEPSEGSAPGTSTEPSEGSAPGTSESATPESGPGSEPATSGSET PGSEPATSGSETPGSPAGSPTSTEEGTSESATPESGPGTSTEPSEGSAPGTSTEPSEG SAPGSPAGSPTSTEEGTSTEPSEGSAPGTSTEPSEGSAPGTSESATPESGPGTSTEPS EGSAPGTSESATPESGPGSEPATSGSETPGTSTEPSEGSAPGTSTEPSEGSAPGTSES ATPESGPGTSESATPESGPGSPAGSPTSTEEGTSESATPESGPGSEPATSGSETPGTS ESATPESGPGTSTEPSEGSAPGTSTEPSEGSAPGTSTEPSEGSAPGTSTEPSEGSAPG TSTEPSEGSAPGTSTEPSEGSAPGSPAGSPTSTEEGTSTEPSEGSAPGTSESATPESG PGSEPATSGSETPGTSESATPESGPGSEPATSGSETPGTSESATPESGPGTSTEPSEG SAPGTSESATPESGPGSPAGSPTSTEEGSPAGSPTSTEEGSPAGSPTSTEEGTSESAT PESGPGTSTEPSEGSAPGTSESATPESGPGSEPATSGSETPGTSESATPESGPGSEPA TSGSETPGTSESATPESGPGTSTEPSEGSAPGSPAGSPTSTEEGTSESATPESGPGSE PATSGSETPGTSESATPESGPGSPAGSPTSTEEGSPAGSPTSTEEGTSTEPSEGSAPG TSESATPESGPGTSESATPESGPGTSESATPESGPGSEPATSGSETPGSEPATSGSET PGSPAGSPTSTEEGTSTEPSEGSAPGTSTEPSEGSAPGSEPATSGSETPGTSESATPE SGPGTSTEPSEGSAPGHHHHHH (SEQ ID NO.: 962) |
| AC1524 | PSMA | DIQMTQSPSSLSTSVGDRVTLTCKASQDVGTAVDWYQQKPGPSPKLLIYWASTRHTGI PSRFSGSGSGTDFTLTISSLQPEDFADYYCQQYNSYPLTFGPGTKVDIKGATPPETGA ETESPGETTGGSAESEPPGEGEVQLVQSGPEVKKPGATVKISCKTSGYTFTEYTIHWV KQAPGKGLEWIGNINPNNGGTTYNQKFEDKATLTVDKSTDTAYMELSSLRSEDTAVYY CAAGWNFDYWGQGTLLTVSSGGGGSDIQMTQSPSSLSASVGDRVTITCRASQDIRNYL NWYQQKPGKAPKLLIYYTSRLESGVPSRFSGSGSGTDYTLTISSLQPEDFATYYCQQG NTLPWTFGQGTKVEIKGATPPETGAETESPGETTGGSAESEPPGEGEVQLVESGGGLV QPGGSLRLSCAASGYSFTGYTMNWVRQAPGKGLEWVALINPYKGVSTYNQKFKDRFTI SVDKSKNTAYLQMNSLRAEDTAVYYCARSGYYGDSDWYFDVWGQGTLVTVSSGSPGSP AGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTE EGTSESATPESGPGTSTEPSEGSAPGTSTEPSEGSAPGSPAGSPTSTEEGTSTEPSEG SAPGTSTEPSEGSAPGTSESATPESGPGTSTEPSEGSAPGTSESATPESGPGSEPATS GSETPGTSTEPSEGSAPGTSTEPSEGSAPGTSESATPESGPGTSESATPESGPGSPAG SPTSTEEGTSESATPESGPGSEPATSGSETPGTSESATPESGPGTSTEPSEGSAPGTS TEPSEGSAPGTSTEPSEGSAPGTSTEPSEGSAPGTSTEPSEGSAPGTSTEPSEGSAPG SPAGSPTSTEEGTSTEPSEGSAPGTSESATPESGPGSEPATSGSETPGTSESATPESG PGSEPATSGSETPGTSESATPESGPGTSTEPSEGSAPGTSESATPESGPGSPAGSPTS TEEGSPAGSPTSTEEGSPAGSPTSTEEGTSESATPESGPGTSTEPSEGSAPGTSESAT PESGPGSEPATSGSETPGTSESATPESGPGTSESATPESGPGTSE PSEGSAPGSPAGSPTSTEEGTSESATPESGPGSEPATSGSETPGTSESATPESGPGSP AGSPTSTEEGSPAGSPTSTEEGTSTEPSEGSAPGTSESATPESGPGTSESATPESGPG TSESATPESGPGSEPATSGSETPGSEPATSGSETPGSPAGSPTSTEEGTSTEPSEGSA PGTSTEPSEGSAPGSEPATSGSETPGTSESATPESGPGTSTEPSEGSAPGHHHHHH (SEQ ID NO.: 963) |
| AC1553X | mouse EpCAM | DIQMTQSPASLSASLGETVSIECLASEGISNDLAWYQQKSGKSPQLLIYATSRLQDGV PSRFSGSGSGTRYSLKISGMQPEDEADYFCQQSYKYPWTFGGGTKLELKGATPPETGA ETESPGETTGGSAESEPPGEGEVQLAESGGGLVQPGRSMKLSCAASGFTFSNFPMAWV RQAPTKGLEWVATISTSGGSTYYRDSVKGRFTISRDNAKSTLYLQMNSLRSEDTATYY CTRTLYILRVFYFDWGQGVMVTVSSGGGGSDIQMTQSPSSLPASLGDRVTINCQASQ DISNYLNWYQQKPGKAPKLLIYYTNKLADGVPSRFSGSGRDSSFTISSLESEDIGS YYCQQYYNYPWTFGPGTKLEIKGATPPETGAETESPGETTGGSAESEPPGEGEVQLVE SGGGLVQPGKSLKLSCEASGFTFSGYGMHWVRQAPGRGLESVAYITSSSINIKYADAV KGRFTVSRDNAKNLLFLQMNILKSEDTAMYYCARFDWDKNYWGQGTMVTVSSGTAEAA SASGLSGRSDNHSPLGLAGSPGSPAGSPTSTEEGTSESATPESGPGTSTEPSEGSAPG SPAGSPTSTEEGTSTEPSEGSAPGTSTEPSEGSAPGTSESATPESGPGSEPATSGSET |

TABLE 14-continued

Amino acid sequences of ProTIA constructs

| Construct ID | Tumor Targets | Amino Acid Sequences |
|---|---|---|
| | | PGSEPATSGSETPGSPAGSPTSTEEGTSESATPESGPGTSTEPSEGSAPGTSTEPSEG SAPGSPAGSPTSTEEGTSTEPSEGSAPGTSTEPSEGSAPGTSESATPESGPGTSTEPS EGSAPGTSESATPESGPGSEPATSGSETPGTSTEPSEGSAPGTSTEPSEGSAPGTSES ATPESGPGTSESATPESGPGSPAGSPTSTEEGTSESATPESGPGSEPATSGSETPGTS ESATPESGPGTSTEPSEGSAPGTSTEPSEGSAPGTSTEPSEGSAPGTSTEPSEGSAPG TSTEPSEGSAPGTSTEPSEGSAPGSPAGSPTSTEEGTSTEPSEGSAPGTSESATPESG PGSEPATSGSETPGTSESATPESGPGSEPATSGSETPGTSESATPESGPGTSTEPSEG SAPGTSESATPESGPGSPAGSPTSTEEGSPAGSPTSTEEGSPAGSPTSTEEGTSESAT PESGPGTSTEPSEGSAPGTSESATPESGPGSEPATSGSETPGTSESATPESGPGSEPA TSGSETPGTSESATPESGPGTSTEPSEGSAPGSPAGSPTSTEEGTSESATPESGPGSE PATSGSETPGTSESATPESGPGSPAGSPTSTEEGSPAGSPTSTEEGTSTEPSEGSAPG TSESATPESGPGTSESATPESGPGTSESATPESGPGSEPATSGSETPGSEPATSGSET PGSPAGSPTSTEEGTSTEPSEGSAPGTSTEPSEGSAPGSEPATSGSETPGTSESATPE SGPGTSTEPSEGSAPGHHHHHH (SEQ ID NO.: 964) |
| AC1553A | mouse EpCAM | DIQMTQSPASLSASLGETVSIECLASEGISNDLAWYQQKSGKSPQLLIYATSRLQDGV PSRFSGSGSGTRYSLKISGMQPEDEADYFCQQSYKYPWTFGGGTKLELKGATPPETGA ETESPGETTGGSAESEPPGEGEVQLAESGGGLVQPGRSMKLSCAASGFTFSNFPMAWV RQAPTKGLEWVATISTSGGSTYYRDSVKGRFTISRDNAKSTLYLQMNSLRSEDTATYY CTRTLYILRVFYFDYWGQGVMVTVSSGGGGSDIQMTQSPSSLPASLGDRVTINCQASQ DISNYLNWYQQKPGKAPKLLIYYTNKLADGVPSRFSGSGSGRDSSFTISSLESEDIGS YYCQQYYNYPWTFGPGTKLEIKGATPPETGAETESPGETTGGSAESEPPGEGEVQLVE SGGGLVQPGKSLKLSCEASGFTFSGYGMHWVRQAPGRGLESVAYITSSSINIKYADAV KGRFTVSRDNAKNLLFLQMNILKSEDTAMYYCARFDWDKNYWGQGTMVTVSSGTAEAA SASGLSGRSDNHSPLG (SEQ ID NO.: 965) |
| AC1684 | EpCAM | DIQMTQSPSSLSASVGDRVTITCRSTKSLLHSNGITYLYWYQQKPGKAPKLLIYQMSN LASGVPSRFSSSGSGTDFTLTISSLQPEDFATYYCAQNLEIPRTFGQGTKVEIKGATP PETGAETESPGETTGGSAESEPPGEGQVQLVQSGPGLVQPGGSVRISCAASGYTFTNY GMNWVKQAPGKGLEWMGWINTYTGESTYADSFKGRFTFSLDTSASAAYLQINSLRAED TAVYYCARFAIKGDYWGQGTLLTVSSGGGGSDIQMTQSPSSLSASVGDRVTITCRASQ DIRNYLNWYQQKPGKAPKLLIYYTSRLESGVPSRFSGSGSGTDYTLTISSLQPEDFAT YYCQQGNTLPWTFGQGTKVEIKGATPPETGAETESPGETTGGSAESEPPGEGEVQLVE SGGGLVQPGGSLRLSCAASGYSFTGYTMNWVRQAPGKGLEWVALINPYKGVSTYNQKF KDRFTISVDKSKNTAYLQMNSLRAEDTAVYYCARSGYYGDSDWYFDVWGQGTLVTVSS GTAEAASASGESGRAANTEPPELGAGPGSPAGSPTSTEEGTSESATPESGPGTSTEPS EGSAPGSPAGSPTSTEEGTSTEPSEGSAPGTSTEPSEGSAPGTSESATPESGPGSEPA TSGSETPGSEPATSGSETPGSPAGSPTSTEEGTSESATPESGPGTSTEPSEGSAPGTS TEPSEGSAPGSPAGSPTSTEEGTSTEPSEGSAPGTSTEPSEGSAPGTSESATPESGPG TSTEPSEGSAPGTSESATPESGPGSEPATSGSETPGTSTEPSEGSAPGTSTEPSEGSA PGTSESATPESGPGTSESATPESGPGSPAGSPTSTEEGTSESATPESGPGSEPATSGS ETPGTSESATPESGPGTSTEPSEGSAPGTSTEPSEGSAPGTSTEPSEGSAPGTSTEPS EGSAPGTSTEPSEGSAPGTSTEPSEGSAPGSPAGSPTSTEEGTSTEPSEGSAPGTSES ATPESGPGSEPATSGSETPGTSESATPESGPGSEPATSGSETPGTSESATPESGPGTS TEPSEGSAPGTSESATPESGPGSPAGSPTSTEEGSPAGSPTSTEEGSPAGSPTSTEEG TSESATPESGPGTSTEPSEGSAPGTSESATPESGPGSEPATSGSETPGTSESATPESG PGSEPATSGSETPGTSESATPESGPGTSTEPSEGSAPGSPAGSPTSTEEGTSESATPE SGPGSEPATSGSETPGTSESATPESGPGSPAGSPTSTEEGSPAGSPTSTEEGTSTEPS EGSAPGTSESATPESGPGTSESATPESGPGSEPATSGSETPGSEPA TSGSETPGSPAGSPTSTEEGTSTEPSEGSAPGTSTEPSEGSAPGSEPATSGSETPGTS ESATPESGPGTSTEPSEGSAPGHHHHHH (SEQ ID NO.: 966) |
| AC1685 | EpCAM | DIQMTQSPSSLSASVGDRVTITCRSTKSLLHSNGITYLYWYQQKPGKAPKLLIYQMSNL ASGVPSRFSSSGSGTDFTLTISSLQPEDFATYYCAQNLEIPRTFGQGTKVEIKGATPPE TGAETESPGETTGGSAESEPPGEGQVQLVQSGPGLVQPGGSVRISCAASGYTFTNYGMN WVKQAPGKGLEWMGWINTYTGESTYADSFKGRFTFSLDTSASAAYLQINSLRAEDTAVY YCARFAIKGDYWGQGTLLTVSSGGGGSDIQMTQSPSSLSASVGDRVTITCRASQDIRNY LNWYQQKPGKAPKLLIYYTSRLESGVPSRFSGSGSGTDYTLTISSLQPEDFATYYCQQG NTLPWTFGQGTKVEIKGATPPETGAETESPGETTGGSAESEPPGEGEVQLVESGGGLVQ PGGSLRLSCAASGYSFTGYTMNWVRQAPGKGLEWVALINPYKGVSTYNQKFKDRFTISV DKSKNTAYLQMNSLRAEDTAVYYCARSGYYGDSDWYFDVWGQGTLVTVSSGTAEAASAS GESGRAANTAPEGLTGPPGSPAGSPTSTEEGTSESATPESGPGTSTEPSEGSAPGSPAG SPTSTEEGTSTEPSEGSAPGTSTEPSEGSAPGTSESATPESGPGSEPATSGSETPGSEP ATSGSETPGSPAGSPTSTEEGTSESATPESGPGTSTEPSEGSAPGTSTEPSEGSAPGSP AGSPTSTEEGTSTEPSEGSAPGTSTEPSEGSAPGTSESATPESGPGTSTEPSEGSAPGT SESATPESGPGSEPATSGSETPGTSTEPSEGSAPGTSTEPSEGSAPGTSESATPESGPG TSESATPESGPGSPAGSPTSTEEGTSESATPESGPGSEPATSGSETPGTSESATPESGP GTSTEPSEGSAPGTSTEPSEGSAPGTSTEPSEGSAPGTSTEPSEGSAPGTSTEPSEGSA PGTSTEPSEGSAPGSPAGSPTSTEEGTSTEPSEGSAPGTSESATPESGPGSEPATSGSE TPGTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEPSE GSAPGTSESATPESGPGSEPATSGSETPGTSESATPESGPGSEPATSGSETPGTSESAT PESGPGTSTEPSEGSAPGSPAGSPTSTEEGTSESATPESGPGSEPATSGSETPGTSESA TPESGPGSPAGSPTSTEEGSPAGSPTSTEEGTSTEPSEGSAPGTSESATPESGPGTSES ATPESGPGTSESATPESGPGSEPATSGSETPGSEPATSGSETPGSPAGSPTSTEEGTST |

TABLE 14-continued

Amino acid sequences of ProTIA constructs

| Construct ID | Tumor Targets | Amino Acid Sequences |
|---|---|---|
| | | EPSEGSAPGTSTEPSEGSAPGSEPATSGSETPGTSESATPESGPGTSTEPSEGSAPGHH HHHH (SEQ ID NO.: 967) |
| AC1686 | EpCAM | DIQMTQSPSSLSASVGDRVTITCRSTKSLLHSNGITYLYWYQQKPGKAPKLLIYQMSNL ASGVPSRFSSSGSGTDFTLTISSLQPEDFATYYCAQNLEIPRTFGQGTKVEIKGATPPE TGAETESPGETTGGSAESEPPGEGQVQLVQSGPGLVQPGGSVRISCAASGYTFTNYGMN WVKQAPGKGLEWMGWINTYTGESTYADSFKGRFTFSLDTSASAAYLQINSLRAEDTAVY YCARFAIKGDYWGQGTLLTVSSGGGGSDIQMTQSPSSLSASVGDRVTITCRASQDIRNY LNWYQQKPGKAPKLLIYYTSRLESGVPSRFSGSGSGTDYTLTISSLQPEDFATYYCQQG NTLPWTFGQGTKVEIKGATPPETGAETESPGETTGGSAESEPPGEGEVQLVESGGGLVQ PGGSLRLSCAASGYSFTGYTMNWVRQAPGKGLEWVALINPYKGVSTYNQKFKDRFTISV DKSKNTAYLQMNSLRAEDTAVYYCARSGYYGDSDWYFDVWGQGTLVTVSSGTAEAASAS GEPGRAANHEPSGLTEGPGSPAGSPTSEEGTSESATPESGPGTSTEPSEGSAPGSPAG SPTSTEEGTSTEPSEGSAPGTSTEPSEGSAPGTSESATPESGPGSEPATSGSETPGSEP ATSGSETPGSPAGSPTSTEEGTSESATPESGPGTSTEPSEGSAPGTSTEPSEGSAPGSP AGSPTSTEEGTSTEPSEGSAPGTSTEPSEGSAPGTSTEPSEGSAPGT SESATPESGPGSEPATSGSETPGTSTEPSEGSAPGTSTEPSEGSAPGTSESATPESGPG TSESATPESGPGSPAGSPTSTEEGTSESATPESGPGSEPATSGSETPGTSESATPESGP GTSTEPSEGSAPGTSTEPSEGSAPGTSTEPSEGSAPGTSTEPSEGSAPGTSTEPSEGSA PGTSTEPSEGSAPGSPAGSPTSTEEGTSTEPSEGSAPGTSESATPESGPGSEPATSGSE TPGTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEPSE GSAPGTSESATPESGPGSEPATSGSETPGTSESATPESGPGSEPATSGSETPGTSESAT PESGPGTSTEPSEGSAPGSPAGSPTSTEEGSPAGSPTSTEEGSPAGSPTSTEEGSPAGSEPATSGSETPGTSESA TPESGPGSPAGSPTSTEEGSPAGSPTSTEEGTSTEPSEGSAPGTSESATPESGPGTSES ATPESGPGTSESATPESGPGSEPATSGSETPGSEPATSGSETPGSPAGSPTSTEEGTST EPSEGSAPGTSTEPSEGSAPGSEPATSGSETPGTSESATPESGPGTSTEPSEGSAPGHH HHHH (SEQ ID NO.: 968) |
| AC1693 | EpCAM | DIQMTQSPSSLSASVGDRVTITCRSTKSLLHSNGITYLYWYQQKPGKAPKLLIYQMSNL ASGVPSRFSSSGSGTDFTLTISSLQPEDFATYYCAQNLEIPRTFGQGTKVEIKGATPPE TGAETESPGETTGGSAESEPPGEGQVQLVQSGPGLVQPGGSVRISCAASGYTFTNYGMN WVKQAPGKGLEWMGWINTYTGESTYADSFKGRFTFSLDTSASAAYLQINSLRAEDTAVY YCARFAIKGDYWGQGTLLTVSSGGGGSDIQMTQSPSSLSASVGDRVTITCRASQDIRNY LNWYQQKPGKAPKLLIYYTSRLESGVPSRFSGSGSGTDYTLTISSLQPEDFATYYCQQG NTLPWTFGQGTKVEIKGATPPETGAETESPGETTGGSAESEPPGEGEVQLVESGGGLVQ PGGSLRLSCAASGYSFTGYTMNWVRQAPGKGLEWVALINPYKGVSTYNQKFKDRFTISV DKSKNTAYLQMNSLRAEDTAVYYCARSGYYGDSDWYFDVWGQGTLVTVSSGTAEAASAS GESGRAANHTGAPPGGLTGPPGSPAGSPTSTEEGTSESATPESGPGTSTEPSEGSAPGS PAGSPTSTEEGTSTEPSEGSAPGTSTEPSEGSAPGTSESATPESGPGSEPATSGSETPG SEPATSGSETPGSPAGSPTSTEEGTSESATPESGPGTSTEPSEGSAPGTSTEPSEGSAP GSPAGSPTSTEEGTSTEPSEGSAPGTSTEPSEGSAPGTSESATPESGPGTSTEPSEGSA PGTSESATPESGPGSEPATSGSETPGTSTEPSEGSAPGTSTEPSEGSAPGTSESATPES GPGTSESATPESGPGSPAGSPTSTEEGTSESATPESGPGSEPATSGSETPGTSESATPE SGPGTSTEPSEGSAPGTSTEPSEGSAPGTSTEPSEGSAPGTSTEPSE GSAPGTSTEPSEGSAPGSPAGSPTSTEEGTSTEPSEGSAPGTSESATPESGPGSEPATS GSETPGTSESATPESGPGSEPATSGSETPGTSESATPESGPGTSTEPSEGSAPGTSESA TPESGPGSPAGSPTSTEEGSPAGSPTSTEEGSPAGSPTSTEEGTSESATPESGPGTSTE PSEGSAPGTSESATPESGPGSEPATSGSETPGTSESATPESGPGSEPATSGSETPGTSE SATPESGPGTSTEPSEGSAPGSPAGSPTSTEEGTSESATPESGPGSEPATSGSETPGTS ESATPESGPGSPAGSPTSTEEGSPAGSPTSTEEGTSTEPSEGSAPGTSESATPESGPGT SESATPESGPGTSESATPESGPGSEPATSGSETPGSEPATSGSETPGSPAGSPTSTEEG TSTEPSEGSAPGTSTEPSEGSAPGSEPATSGSETPGTSESATPESGPGTSTEPSEGSAP GHHHHHH (SEQ ID NO.: 969) |
| AC1695 | EpCAM | DIQMTQSPSSLSASVGDRVTITCRSTKSLLHSNGITYLYWYQQKPGKAPKLLIYQMSNL ASGVPSRFSSSGSGTDFTLTISSLQPEDFATYYCAQNLEIPRTFGQGTKVEIKGATPPE TGAETESPGETTGGSAESEPPGEGQVQLVQSGPGLVQPGGSVRISCAASGYTFTNYGMN WVKQAPGKGLEWMGWINTYTGESTYADSFKGRFTFSLDTSASAAYLQINSLRAEDTAVY YCARFAIKGDYWGQGTLLTVSSGGGGSDIQMTQSPSSLSASVGDRVTITCRASQDIRNY LNWYQQKPGKAPKLLIYYTSRLESGVPSRFSGSGSGTDYTLTISSLQPEDFATYYCQQG NTLPWTFGQGTKVEIKGATPPETGAETESPGETTGGSAESEPPGEGEVQLVESGGGLVQ PGGSLRLSCAASGYSFTGYTMNWVRQAPGKGLEWVALINPYKGVSTYNQKFKDRFTISV DKSKNTAYLQMNSLRAEDTAVYYCARSGYYGDSDWYFDVWGQGTLVTVSSGTAEAASAS GTTGRAGEAANLTPAGLTGPPGSPAGSPTSTEEGTSESATPESGPGTSTEPSEGSAPGS PAGSPTSTEEGTSTEPSEGSAPGTSTEPSEGSAPGTSESATPESGPGSEPATSGSETPG SEPATSGSETPGSPAGSPTSTEEGTSESATPESGPGTSTEPSEGSAPGTSTEPSEGSAP GSPAGSPTSTEEGTSTEPSEGSAPGTSTEPSEGSAPGTSESATPESGPGTSTEPSEGSA PGTSESATPESGPGSEPATSGSETPGTSTEPSEGSAPGTSTEPSEGSAPGTSESATPES GPGTSESATPESGPGSPAGSPTSTEEGTSESATPESGPGSEPATSGSETPGTSESATPE SGPGTSTEPSEGSAPGTSTEPSEGSAPGTSTEPSEGSAPGTSTEPSEGSAPGTSTEPSE GSAPGTSTEPSEGSAPGSPAGSPTSTEEGTSTEPSEGSAPGTSESATPESGPGSEPATS GSETPGTSESATPESGPGSEPATSGSETPGTSESATPESGPGTSTEPSEGSAPGTSESA TPESGPGSPAGSPTSTEEGSPAGSPTSTEEGSPAGSPTSTEEGTSESATPESGPGTSTE PSEGSAPGTSESATPESGPGSEPATSGSETPGTSESATPESGPGSEPATSGSETPGTSE |

TABLE 14-continued

Amino acid sequences of ProTIA constructs

| Construct ID | Tumor Targets | Amino Acid Sequences |
|---|---|---|
| | | SATPESGPGTSTEPSEGSAPGSPAGSPTSTEEGTSESATPESGPGSEPATSGSETPGTS
ESATPESGPGSPAGSPTSTEEGSPAGSPTSTEEGTSTEPSEGSAPGTSESATPESGPGT
SESATPESGPGTSESATPESGPGSEPATSGSETPGSEPATSGSETPGSPAGSPTSTEEG
TSTEPSEGSAPGTSTEPSEGSAPGSEPATSGSETPGTSESATPESGPGTSTEPSEGSAP
GHHHHHH (SEQ ID NO.: 970) |
| AC1714 | EpCAM | DIQMTQSPSSLSASVGDRVTITCRSTKSLLHSNGITYLYWYQQKPGKAPKLLIYQMSNL
ASGVPSRFSSSGSGTDFTLTISSLQPEDFATYYCAQNLEIPRTFGQGTKVEIKGATPPE
TGAETESPGETTGGSAESEPPGEGQVQLVQSGPGLVQPGGSVRISCAASGYTFTNYGMN
WVKQAPGKGLEWMGWINTYTGESTYADSFKGRFTFSLDTSASAAYLQINSLRAEDTAVY
YCARFAIKGDYWGQGTLLTVSSGGGGSDIQMTQSPSSLSASVGDRVTITCRASQDIRNY
LNWYQQKPGKAPKLLIYYTSRLESGVPSRFSGSGSGTDYTLTISSLQPEDFATYYCQQG
NTLPWTFGQGTKVEIKGATPPETGAETESPGETTGGSAESEPPGEGEVQLVESGGGLVQ
PGGSLRLSCAASGYSFTGYTMNWVRQAPGKGLEWVALINPYKGVSTYNQKFKDRFTISV
DKSKNTAYLQMNSLRAEDTAVYYCARSGYYGDSDWYFDVWGQGTLVTVSSGTAEAASAS
GEAGRSANHTPAGLTGPPGSPAGSPTSTEEGTSESATPESGPGTSTEPSEGSAPGSPAG
SPTSTEEGTSTEPSEGSAPGTSTEPSEGSAPGTSESATPESGPGSEPATSGSETPGSEP
ATSGSETPGSPAGSPTSTEEGTSESATPESGPGTSTEPSEGSAPGTSTEPSEGSAPGSP
AGSPTSTEEGTSTEPSEGSAPGTSTEPSEGSAPGTSESATPESGPGTSTEPSEGSAPGT
SESATPESGPGSEPATSGSETPGTSTEPSEGSAPGTSTEPSEGSAPGTSESATPESGPG
TSESATPESGPGSPAGSPTSTEEGTSESATPESGPGSEPATSGSETPGTSESATPESGP
GTSTEPSEGSAPGTSTEPSEGSAPGTSTEPSEGSAPGTSTEPSEGSAPGTSTEPSEGSA
PGTSTEPSEGSAPGSPAGSPTSTEEGTSTEPSEGSAPGTSESATPESGPGSEPATSGSE
TPGTSESATPESGPGSEPATSGSETPGTSESATPESGPGTSTEPSEGSAPGTSESATPE
SGPGSPAGSPTSTEEGSPAGSPTSTEEGSPAGSPTSTEEGTSESATPESGPGTSTEPSE
GSAPGTSESATPESGPGSEPATSGSETPGTSESATPESGPGSEPATSGSETPGTSESAT
PESGPGTSTEPSEGSAPGSPAGSPTSTEEGTSESATPESGPGSEPATSGSETPGTSESA
TPESGPGSPAGSPTSTEEGSPAGSPTSTEEGTSTEPSEGSAPGTSESATPESGPGTSES
ATPESGPGTSESATPESGPGSEPATSGSETPGSEPATSGSETPGSPAGSPTSTEEGTST
EPSEGSAPGTSTEPSEGSAPGSEPATSGSETPGTSESATPESGPGTSTEPSEGSAPGHH
HHHH (SEQ ID NO.: 971) |
| AC1715 | EpCAM | DIQMTQSPSSLSASVGDRVTITCRSTKSLLHSNGITYLYWYQQKPGKAPKLLIYQMSNL
ASGVPSRFSSSGSGTDFTLTISSLQPEDFATYYCAQNLEIPRTFGQGTKVEIKGATPPE
TGAETESPGETTGGSAESEPPGEGQVQLVQSGPGLVQPGGSVRISCAASGYTFTNYGMN
WVKQAPGKGLEWMGWINTYTGESTYADSFKGRFTFSLDTSASAAYLQINSLRAEDTAVY
YCARFAIKGDYWGQGTLLTVSSGGGGSDIQMTQSPSSLSASVGDRVTITCRASQDIRNY
LNWYQQKPGKAPKLLIYYTSRLESGVPSRFSGSGSGTDYTLTISSLQPEDFATYYCQQG
NTLPWTFGQGTKVEIKGATPPETGAETESPGETTGGSAESEPPGEGEVQLVESGGGLVQ
PGGSLRLSCAASGYSFTGYTMNWVRQAPGKGLEWVALINPYKGVSTYNQKFKDRFTISV
DKSKNTAYLQMNSLRAEDTAVYYCARSGYYGDSDWYFDVWGQGTLVTVSSGTAEAASAS
GESGRAANTTPAGLTGPPGSPAGSPTSTEEGTSESATPESGPGTSTEPSEGSAPGSPAG
SPTSTEEGTSTEPSEGSAPGTSTEPSEGSAPGTSESATPESGPGSEPATSGSETPGSEP
ATSGSETPGSPAGSPTSTEEGTSESATPESGPGTSTEPSEGSAPGTSTEPSEGSAPGSP
AGSPTSTEEGTSTEPSEGSAPGTSTEPSEGSAPGTSESATPESGPGTSTEPSEGSAPGT
SESATPESGPGSEPATSGSETPGTSTEPSEGSAPGTSTEPSEGSAPGTSESATPESGPG
TSESATPESGPGSPAGSPTSTEEGTSESATPESGPGSEPATSGSETPGTSESATPESGP
GTSTEPSEGSAPGTSTEPSEGSAPGTSTEPSEGSAPGTSTEPSEGSAPGTSTEPSEGSA
PGTSTEPSEGSAPGSPAGSPTSTEEGTSTEPSEGSAPGTSESATPESGPGSEPATSGSE
TPGTSESATPESGPGSEPATSGSETPGTSESATPESGPGTSTEPSEGSAPGTSESATPE
SGPGSPAGSPTSTEEGSPAGSPTSTEEGSPAGSPTSTEEGTSESATPESGPGTSTEPSE
GSAPGTSESATPESGPGSEPATSGSETPGTSESATPESGPGSEPATSGSETPGTSESAT
PESGPGTSTEPSEGSAPGSPAGSPTSTEEGTSESATPESGPGSEPATSGSETPGTSESA
TPESGPGSPAGSPTSTEEGSPAGSPTSTEEGTSTEPSEGSAPGTSESATPESGPGTSES
ATPESGPGTSESATPESGPGSEPATSGSETPGSEPATSGSETPGSPAGSPTSTEEGTST
EPSEGSAPGTSTEPSEGSAPGSEPATSGSETPGTSESATPESGPGTSTEPSEGSAPGHH
HHHH (SEQ ID NO.: 972) |

TABLE 15

Amino acid sequences of ProTIA constructs

| Construct ID | Tumor Targets | Amino Acid Sequences |
|---|---|---|
| AC1949 | EpCAM | SPAGSPTSTEEGTSESATPESGPGTSTEPSEGSAPGTSESATPESGPGSEPATSGSETPGTSESA
TPESGPGSEPATSGSETPGTSESATPESGPGTSTEPSEGSAPGSPAGSPTSTEEGTSESATPESG
PGSEPATSGSETPGTSESATPESGPGSPAGSPTSTEEGSPAGSPTSTEEGTSTEPSEGSAPGTSE
SATPESGPGTSESATPESGPGTSESATPESGPGSEPATSGSETPGSEPATSGSETPGSPAGSPTS
TEEGTSTEPSEGSAPGTSTEPSEGSAPGGSAPTTGEAGEAAGATSAGATGPATSGSETPGTDIQM
TQSPSSLSASVGDRVTITCRSTKSLLHSNGITYLYWYQQKPGKAPKLLIYQMSNLASGVPSRFSS
SGSGTDFTLTISSLQPEDFATYYCAQNLEIPRTFGQGTKVEIKGATPPETGAETESPGETTGGSA |

TABLE 15-continued

Amino acid sequences of ProTIA constructs

| Construct ID | Tumor Targets | Amino Acid Sequences |
|---|---|---|
| | | ESEPPGEGQVQLVQSGPGLVQPGGSVRISCAASGYTFTNYGMNWVKQAPGKGLEWMGWINTYTGE STYADSFKGRFTFSLDTSASAAYLQINSLRAEDTAVYYCARFAIKGDYWGQGTLLTVSSGGGGSD IQMTQSPSSLPASLGDRVTINCQASQDISNYLNWYQQKPGKAPKLLIYYTNKLADGVPSRFSGSG SGRDSSFTISSLESEDIGSYYCQQYYNYPWTFGPGTKLEIKGATPPETGAETESPGETTGGSAES EPPGEGEVQLVESGGGLVQPGKSLKLSCEASGFTFSGYGMHWVRQAPGRGLESVAYITSSSINIK YADAVKGRFTVSRDNAKNLLFLQMNILKSEDTAMYYCARFDWDKNYWGQGTMVTVSSGTAEAASA SGTTGEAGEAAGATSAGATGPPGSPAGSPTSTEEGTSESATPESGPGTSTEPSEGSAPGSPAGSP TSTEEGTSTEPSEGSAPGTSTEPSEGSAPGTSESATPESGPGSEPATSGSETPGSEPATSGSETP GSPAGSPTSTEEGTSESATPESGPGTSTEPSEGSAPGTSTEPSEGSAPGSPAGSPTSTEEGTSTE PSEGSAPGTSTEPSEGSAPGTSESATPESGPGTSTEPSEGSAPGTSESATPESGPGSEPATSGSE TPGTSTEPSEGSAPGTSTEPSEGSAPGTSESATPESGPGTSESATPESGPGSPAGSPTSTEEGTS ESATPESGPGSEPATSGSETPGTSESATPESGPGTSTEPSEGSAPGTSTEPSEGSAPGTSTEPSE GSAPGTSTEPSEGSAPGTSTEPSEGSAPGTSTEPSEGSAPGSPAGSPTSTEEGTSTEPSEGSAPG TSESATPESGPGSEPATSGSETPGTSESATPESGPGSEPATSGSETPGTSESATPESGPGTSTEP SEGSAPGTSESATPESGPGSPAGSPTSTEEGSPAGSPTSTEEGSPAGSPTSTEEGTSESATPESG PGTSTEPSEGSAPGTSESATPESGPGSEPATSGSETPGTSESATPESGPGSEPATSGSETPGTSE SATPESGPGTSTEPSEGSAPGSPAGSPTSTEEGTSESATPESGPGSEPATSGSETPGTSESATPE SGPGSPAGSPTSTEEGSPAGSPTSTEEGTSTEPSEGSAPGTSESATPESGPGTSESATPESGPGT SESATPESGPGSEPATSGSETPGSEPATSGSETPGSPAGSPTSTEEGTSTEPSEGSAPGTSTEPS EGSAPGSEPATSGSETPGTSESATPESGPGTSTEPSEGSAPGHHHHHH (SEQ ID NO.: 973) |
| AC1991 | EGFR | HHHHHHSPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEEGTSTEPSEGS APGTSESATPESGPGTSESATPESGPGTSESATPESGPGSEPATSGSETPGSEPATSGSETPGSP AGSPTSTEEGTSTEPSEGSAPGTSTEPSEGSAPGGSAPTTGEAGEAAGATSAGATGPATSGSETP GTDIQMTQSPSSLSASVGDRVTITCQASQDISNYLNWYQQKPGKAPKLLIYDASNLETGVPSRFS GSGSGTDFTFTISSLQPEDIATYFCQHFDHLPLAFGGGTKVEIKGATPPETGAETESPGETTGGS AESEPPGEGQVQLQESGPGLVKPSETLSLTCTVSGGSVSSGDYYWTWIRQSPGKGLEWIGHIYYS GNTNYNPSLKSRLTISIDTSKTQFSLKLSSVTAADTAIYYCVRDRVTGAPFDIWGQGTMVTVSSGG GGSELVVTQEPSLTVSPGGTVTLTCRSSTGAVTTSNYANWVQQKPGQAPRGLIGGTNKRAPGTPA RFSGSLLGGKAALTLSGVQPEDEAEYYCALWYSNLWVFGGGTKLTVLGATPPETGAETESPGETT GGSAESEPPGEGEVQLLESGGGLVQPGGSLKLSCAASGFTFNTYAMNWVRQAPGKGLEWVARIRS KYNNYATYYADSVKDRFTISRDDSKNTAYLQMNNLKTEDTAVYYCVRHGNFGNSYVSWFAYWGQG TLVTVSSGTAEAASASGTTGEAGEAAGATSAGATGPPGSPAGSPTSTEEGTSESATPESGPGTST EPSEGSAPGSPAGSPTSTEEGTSTEPSEGSAPGTSTEPSEGSAPGTSESATPESGPGSEPATSGS ETPGSEPATSGSETPGSPAGSPTSTEEGTSESATPESGPGTSTEPSEGSAPGTSTEPSEGSAPGS PAGSPTSTEEGTSTEPSEGSAPGTSTEPSEGSAPGTSESATPESGPGTSTEPSEGSAPGTSESAT PESGPGSEPATSGSETPGTSTEPSEGSAPGTSTEPSEGSAPGTSESATPESGPGTSESATPESGP GSPAGSPTSTEEGTSESATPESGPGSEPATSGSETPGTSESATPESGPGTSTEPSEGSAPGTSTE PSEGSAPGTSTEPSEGSAPGTSTEPSEGSAPGTSTEPSEGSAPGTSTEPSEGSAPGSPAGSPTST EEGTSTEPSEGSAPGTSESATPESGPGSEPATSGSETPGTSESATPESGPGSEPATSGSETPGTS ESATPESGPGTSTEPSEGSAPGTSESATPESGPGSPAGSPTSTEEGSPAGSPTSTEEGSPAGSPT STEEGTSESATPESGPGTSTEPSEGSAPGTSESATPESGPGTSESATPESGPGSEPATSGSETPG SEPATSGSETPGTSESATPESGPGTSTEPSEGSAPGSPAGSPTSTEEGTSESATPESGPGSEPAT SGSETPGTSESATPESGPGSPAGSPTSTEEGSPAGSPTSTEEGTSTEPSEGSAPGTSESATPESG PGTSESATPESGPGTSESATPESGPGSEPATSGSETPGSEPATSGSETPGSPAGSPTSTEEGTST EPSEGSAPGTSTEPSEGSAPGSEPATSGSETPGTSESATPESGPGTSTEPSEGSAPGEPEA (SEQ ID NO.: 974) |
| AC2011 | Her2 | HHHHHHSPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEEGTSTEPSEGS APGTSESATPESGPGTSESATPESGPGTSESATPESGPGSEPATSGSETPGSEPATSGSETPGSP AGSPTSTEEGTSTEPSEGSAPGTSTEPSEGSAPGGSAPTTGEAGEAAGATSAGATGPATSGSETP GTDIQMTQSPSSLSASVGDRVTITCRASQDVNTAVAWYQQKPGKAPKLLIYSASFLYSGVPSRFS GSRSGTDFTLTISSLQPEDFATYYCQQHYTTPPTFGQGTKVEIKGATPPETGAETESPGETTGGS AESEPPGEGEVQLVESGGGLVQPGGSLRLSCAASGFNIKDTYIHWVRQAPGKGLEWVARIYPTNG YTRYADSVKGRFTISADTSKNTAYLQMNSLRAEDTAVYYCSRWGGDGFYAMDYWGQGTLVTVSSG GGGSELVVTQEPSLTVSPGGTVTLTCRSSTGAVTTSNYANWVQQKPGQAPRGLIGGTNKRAPGTP ARFSGSLLGGKAALTLSGVQPEDEAEYYCALWYSNLWVFGGGTKLTVLGATPPETGAETESPGET TGGSAESEPPGEGEVQLLESGGGLVQPGGSLKLSCAASGFTFNTYAMNWVRQAPGKGLEWVARIR SKYNNYATYYADSVKDRFTISRDDSKNTAYLQMNNLKTEDTAVYYCVRHGNFGNSYVSWFAYWGQ GTLVTVSSGTAEAASASGTTGEAGEAAGATSAGATGPPGSPAGSPTSTEEGTSESATPESGPGTS TEPSEGSAPGSPAGSPTSTEEGTSTEPSEGSAPGTSTEPSEGSAPGTSESATPESGPGSEPATSG SETPGSEPATSGSETPGSPAGSPTSTEEGTSESATPESGPGTSTEPSEGSAPGTSTEPSEGSAPG SPAGSPTSTEEGTSTEPSEGSAPGTSTEPSEGSAPGTSESATPESGPGTSTEPSEGSAPGTSESA TPESGPGSEPATSGSETPGTSTEPSEGSAPGTSTEPSEGSAPGTSESATPESGPGTSESATPESG PGSPAGSPTSTEEGTSESATPESGPGSEPATSGSETPGTSESATPESGPGTSTEPSEGSAPGTST EPSEGSAPGTSTEPSEGSAPGTSTEPSEGSAPGTSTEPSEGSAPGTSTEPSEGSAPGSPAGSPTS TEEGTSTEPSEGSAPGTSESATPESGPGSEPATSGSETPGTSESATPESGPGSEPATSGSETPGT SESATPESGPGTSTEPSEGSAPGTSESATPESGPGSPAGSPTSTEEGSPAGSPTSTEEGSPAGSP TSTEEGTSESATPESGPGTSTEPSEGSAPGTSESATPESGPGSEPATSGSETPGTSESATPESGP GSEPATSGSETPGTSESATPESGPGTSTEPSEGSAPGSPAGSPTSTEEGTSESATPESGPGSEPA |

TABLE 15-continued

Amino acid sequences of ProTIA constructs

| Construct ID | Tumor Targets | Amino Acid Sequences |
|---|---|---|
| | | TSGSETPGTSESATPESGPGSPAGSPTSTEEGSPAGSPTSTEEGTSTEPSEGSAPGTSESATPES<br>GPGTSESATPESGPGSEPATSGSETPGSEPATSGSETPGSPAGSPTSTEEGTS<br>TEPSEGSAPGTSTEPSEGSAPGSEPATSGSETPGTSESATPESGPGTSTEPSEGAAEPEA<br>(SEQ ID NO.: 975) |
| AC2091 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPEAGRSAEATSAGATGPATSGSETPGTD<br>IQMTQSPSSLSASVGDRVTITCRASQDVNTAVAWYQQKPGKAPKLLIYSASFLYSGVPSRFSGSR<br>SGTDFTLTISSLQPEDFATYYCQQHYTTPPTFGQGTKVEIKGATPPETGAETESPGETTGGSAES<br>EPPGEGEVQLVESGGGLVQPGGSLRLSCAASGFNIKDTYIHWVRQAPGKGLEWVARTYPTNGYTR<br>YADSVKGRFTISADTSKNTAYLQMNSLRAEDTAVYYCSRWGGDGFYAMDYWGQGTLVTVSSGGGG<br>SELVVTQEPSLTVSPGGTVTLTCRSSTGAVTTSNYANWVQQKPGQAPRGLIGGTNKRAPGTPARF<br>SGSLLGGKAALTLSGVQPEDEAEYYCALWYSNLWVFGGGTKLTVLGATPPETGAETESPGETTGG<br>SAESEPPGEGEVQLLESGGGLVQPGGSLKLSCAASGFTFNTYAMNWVRQAPGKGLEWVARIRSKY<br>NNYATYYADSVKDRFTISRDDSKNTAYLQMNNLKTEDTAVYYCVRHGNFGNSYVSWFAYWGQGTL<br>VTVSSGTAEAASASGEAGRSAEATSAGATGPPGSPAGSPTSTEEGTSESATPESGPGTSTEPSEG<br>SAPGSPAGSPTSTEEGTSTEPSEGSAPGTSTEPSEGSAPGTSESATPESGPGSEPATSGSETPGS<br>EPATSGSETPGSPAGSPTSTEEGTSESATPESGPGTSTEPSEGSAPGTSTEPSEGSAPGSPAGSP<br>TSTEEGTSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTSTEPSEGS<br>APGTSTEPSEGSAPGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGAAEPEA<br>(SEQ ID NO.: 976) |
| AC2092 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPEAGESANATSAGATGPATSGSETPGTD<br>IQMTQSPSSLSASVGDRVTITCRASQDVNTAVAWYQQKPGKAPKLLIYSASFLYSGVPSRFSGSR<br>SGTDFTLTISSLQPEDFATYYCQQHYTTPPTFGQGTKVEIKGATPPETGAETESPGETTGGSAES<br>EPPGEGEVQLVESGGGLVQPGGSLRLSCAASGFNIKDTYIHWVRQAPGKGLEWVARTYPTNGYTR<br>YADSVKGRFTISADTSKNTAYLQMNSLRAEDTAVYYCSRWGGDGFYAMDYWGQGTLVTVSSGGGG<br>SELVVTQEPSLTVSPGGTVTLTCRSSTGAVTTSNYANWVQQKPGQAPRGLIGGTNKRAPGTPARF<br>SGSLLGGKAALTLSGVQPEDEAEYYCALWYSNLWVFGGGTKLTVLGATPPETGAETESPGETTGG<br>SAESEPPGEGEVQLLESGGGLVQPGGSLKLSCAASGFTFNTYAMNWVRQAPGKGLEWVARIRSKY<br>NNYATYYADSVKDRFTISRDDSKNTAYLQMNNLKTEDTAVYYCVRHGNFGNSYVSWFAYWGQGTL<br>VTVSSGTAEAASASGEAGESANATSAGATGPPGSPAGSPTSTEEGTSESATPESGPGTSTEPSEG<br>SAPGSPAGSPTSTEEGTSTEPSEGSAPGTSTEPSEGSAPGTSESATPESGPGSEPATSGSETPGS<br>EPATSGSETPGSPAGSPTSTEEGTSESATPESGPGTSTEPSEGSAPGTSTEPSEGSAPGSPAGSP<br>TSTEEGTSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTSTEPSEGS<br>APGTSTEPSEGSAPGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGAAEPEA<br>(SEQ ID NO.: 977) |
| AC2093 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPEAGESAGATPAGLTPATSGSETPGTD<br>IQMTQSPSSLSASVGDRVTITCRASQDVNTAVAWYQQKPGKAPKLLIYSASFLYSGVPSRFSGSR<br>SGTDFTLTISSLQPEDFATYYCQQHYTTPPTFGQGTKVEIKGATPPETGAETESPGETTGGSAES<br>EPPGEGEVQLVESGGGLVQPGGSLRLSCAASGFNIKDTYIHWVRQAPGKGLEWVARTYPTNGYTR<br>YADSVKGRFTISADTSKNTAYLQMNSLRAEDTAVYYCSRWGGDGFYAMDYWGQGTLVTVSSGGGG<br>SELVVTQEPSLTVSPGGTVTLTCRSSTGAVTTSNYANWVQQKPGQAPRGLIGGTNKRAPGTPARF<br>SGSLLGGKAALTLSGVQPEDEAEYYCALWYSNLWVFGGGTKLTVLGATPPETGAETESPGETTGG<br>SAESEPPGEGEVQLLESGGGLVQPGGSLKLSCAASGFTFNTYAMNWVRQAPGKGLEWVARIRSKY |

TABLE 15-continued

Amino acid sequences of ProTIA constructs

| Construct ID | Tumor Targets | Amino Acid Sequences |
|---|---|---|
| | | NNYATYYADSVKDRFTISRDDSKNTAYLQMNNLKTEDTAVYYCVRHGNFGNSYVSWFAYWGQGTL<br>VTVSSGTAEAASASGEAGESAGATPAGLTGPPGSPAGSPTSTEEGTSESATPESGPGTSTEPSEG<br>SAPGSPAGSPTSTEEGTSTEPSEGSAPGTSTEPSEGSAPGTSESATPESGPGSEPATSGSETPGS<br>EPATSGSETPGSPAGSPTSTEEGTSESATPESGPGTSTEPSEGSAPGTSTEPSEGSAPGSPAGSP<br>TSTEEGTSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTSTEPSEGS<br>APGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGAAEPEA<br>(SEQ ID NO.: 978) |
| AC2094 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGTYSRGESGPGSPATSGSETPGTD<br>IQMTQSPSSLSASVGDRVTITCRASQDVNTAVAWYQQKPGKAPKLLIYSASFLYSGVPSRFSGSR<br>SGTDFTLTISSLQPEDFATYYCQQHYTTPPTFGQGTKVEIKGATPPETGAETESPGETTGGSAES<br>EPPGEGEVQLVESGGGLVQPGGSLRLSCAASGFNIKDTYTHWVRQAPGKGLEWVARTYPTNGYTR<br>YADSVKGRFTISADTSKNTAYLQMNSLRAEDTAVYYCSRWGGDGFYAMDYWGQGTLVTVSSGGGG<br>SELVVTQEPSLTVSPGGTVTLTCRSSTGAVTTSNYANWVQQKPGQAPRGLIGGTNKRAPGTPARF<br>SGSLLGGKAALTLSGVQPEDEAEYYCALWYSNLWVFGGGTKLTVLGATPPETGAETESPGETTGG<br>SAESEPPGEGEVQLLESGGGLVQPGGSLKLSCAASGFTFNTYAMNWVRQAPGKGLEWVARIRSKY<br>NNYATYYADSVKDRFTISRDDSKNTAYLQMNNLKTEDTAVYYCVRHGNFGNSYVSWFAYWGQGTL<br>VTVSSGTAEAASASGSASGTYSRGESGPGSPPGSPAGSPTSTEEGTSESATPESGPGTSTEPSEG<br>SAPGSPAGSPTSTEEGTSTEPSEGSAPGTSTEPSEGSAPGTSESATPESGPGSEPATSGSETPGS<br>EPATSGSETPGSPAGSPTSTEEGTSESATPESGPGTSTEPSEGSAPGTSTEPSEGSAPGSPAGSP<br>TSTEEGTSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTSTEPSEGS<br>APGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGAAEPEA<br>(SEQ ID NO.: 979) |
| AC2095 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGAEGRTDTHPGSPATSGSETPGTD<br>IQMTQSPSSLSASVGDRVTITCRASQDVNTAVAWYQQKPGKAPKLLIYSASFLYSGVPSRFSGSR<br>SGTDFTLTISSLQPEDFATYYCQQHYTTPPTFGQGTKVEIKGATPPETGAETESPGETTGGSAES<br>EPPGEGEVQLVESGGGLVQPGGSLRLSCAASGFNIKDTYIHWVRQAPGKGLEWVARIYPTNGYTR<br>YADSVKGRFTISADTSKNTAYLQMNSLRAEDTAVYYCSRWGGDGFYAMDYWGQGTLVTVSSGGGG<br>SELVVTQEPSLTVSPGGTVTLTCRSSTGAVTTSNYANWVQQKPGQAPRGLIGGTNKRAPGTPARF<br>SGSLLGGKAALTLSGVQPEDEAEYYCALWYSNLWVFGGGTKLTVLGATPPETGAETESPGETTGG<br>SAESEPPGEGEVQLLESGGGLVQPGGSLKLSCAASGFTFNTYAMNWVRQAPGKGLEWVARIRSKY<br>NNYATYYADSVKDRFTISRDDSKNTAYLQMNNLKTEDTAVYYCVRHGNFGNSYVSWFAYWGQGTL<br>VTVSSGTAEAASASGSASGAEGRTDTHPGSPPGSPAGSPTSTEEGTSESATPESGPGTSTEPSEG<br>SAPGSPAGSPTSTEEGTSTEPSEGSAPGTSTEPSEGSAPGTSESATPESGPGSEPATSGSETPGS<br>EPATSGSETPGSPAGSPTSTEEGTSESATPESGPGTSTEPSEGSAPGTSTEPSEGSAPGSPAGSP<br>TSTEEGTSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTSTEPSEGS<br>APGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGAAEPEA<br>(SEQ ID NO.: 980) |

TABLE 15-continued

Amino acid sequences of ProTIA constructs

| Construct ID | Tumor Targets | Amino Acid Sequences |
|---|---|---|
| AC2096 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGEPGRAAEHPGSPATSGSETPGTD<br>IQMTQSPSSLSASVGDRVTITCRASQDVNTAVAWYQQKPGKAPKLLIYSASFLYSGVPSRFSGSR<br>SGTDFTLTISSLQPEDFATYYCQQHYTTPPTFGQGTKVEIKGATPPETGAETESPGETTGGSAES<br>EPPGEGEVQLVESGGGLVQPGGSLRLSCAASGFNIKDTYIHWVRQAPGKGLEWVARIYPTNGYTR<br>YADSVKGRFTISADTSKNTAYLQMNSLRAEDTAVYYCSRWGGDGFYAMDYWGQGTLVTVSSGGGG<br>SELVVTQEPSLTVSPGGTVTLTCRSSTGAVTTSNYANWVQQKPGQAPRGLIGGTNKRAPGTPARF<br>SGSLLGGKAALTLSGVQPEDEAEYYCALWYSNLWVFGGGTKLTVLGATPPETGAETESPGETTGG<br>SAESEPPGEGEVQLLESGGGLVQPGGSLKLSCAASGFTFNTYAMNWVRQAPGKGLEWVARIRSKY<br>NNYATYYADSVKDRFTISRDDSKNTAYLQMNNLKTEDTAVYYCVRHGNFGNSYVSWFAYWGQGTL<br>VTVSSGTAEAASASGSASGEPGRAAEHPGSPPGSPAGSPTSTEEGTSESATPESGPGTSTEPSEG<br>SAPGSPAGSPTSTEEGTSTEPSEGSAPGTSTEPSEGSAPGTSESATPESGPGSEPATSGSETPGS<br>EPATSGSETPGSPAGSPTSTEEGTSESATPESGPGTSTEPSEGSAPGTSTEPSEGSAPGSPAGSP<br>TSTEEGTSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTSTEPSEGS<br>APGTSTEPSEGSAPGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGAAEPEA<br>(SEQ ID NO.: 981) |
| AC2097 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSPAGESSRGTTTAGSPATSGSETPGTD<br>IQMTQSPSSLSASVGDRVTITCRASQDVNTAVAWYQQKPGKAPKLLIYSASFLYSGVPSRFSGSR<br>SGTDFTLTISSLQPEDFATYYCQQHYTTPPTFGQGTKVEIKGATPPETGAETESPGETTGGSAES<br>EPPGEGEVQLVESGGGLVQPGGSLRLSCAASGFNIKDTYTHWVRQAPGKGLEWVARTYPTNGYTR<br>YADSVKGRFTISADTSKNTAYLQMNSLRAEDTAVYYCSRWGGDGFYAMDYWGQGTLVTVSSGGGG<br>SELVVTQEPSLTVSPGGTVTLTCRSSTGAVTTSNYANWVQQKPGQAPRGLIGGTNKRAPGTPARF<br>SGSLLGGKAALTLSGVQPEDEAEYYCALWYSNLWVFGGGTKLTVLGATPPETGAETESPGETTGG<br>SAESEPPGEGEVQLLESGGGLVQPGGSLKLSCAASGFTFNTYAMNWVRQAPGKGLEWVARIRSKY<br>NNYATYYADSVKDRFTISRDDSKNTAYLQMNNLKTEDTAVYYCVRHGNFGNSYVSWFAYWGQGTL<br>VTVSSGTAEAASASGSPAGESSRGTTIAGSPPGSPAGSPTSTEEGTSESATPESGPGTSTEPSEG<br>SAPGSPAGSPTSTEEGTSTEPSEGSAPGTSTEPSEGSAPGTSESATPESGPGSEPATSGSETPGS<br>EPATSGSETPGSPAGSPTSTEEGTSESATPESGPGTSTEPSEGSAPGTSTEPSEGSAPGSPAGSP<br>TSTEEGTSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTSTEPSEGS<br>APGTSTEPSEGSAPGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGAAEPEA<br>(SEQ ID NO.: 982) |
| AC2098 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGEPPELGAGPGSPATSGSETPGTD<br>IQMTQSPSSLSASVGDRVTITCRASQDVNTAVAWYQQKPGKAPKLLIYSASFLYSGVPSRFSGSR<br>SGTDFTLTISSLQPEDFATYYCQQHYTTPPTFGQGTKVEIKGATPPETGAETESPGETTGGSAES<br>EPPGEGEVQLVESGGGLVQPGGSLRLSCAASGFNIKDTYTHWVRQAPGKGLEWVARTYPTNGYTR<br>YADSVKGRFTISADTSKNTAYLQMNSLRAEDTAVYYCSRWGGDGFYAMDYWGQGTLVTVSSGGGG<br>SELVVTQEPSLTVSPGGTVTLTCRSSTGAVTTSNYANWVQQKPGQAPRGLIGGTNKRAPGTPARF<br>SGSLLGGKAALTLSGVQPEDEAEYYCALWYSNLWVFGGGTKLTVLGATPPETGAETESPGETTGG<br>SAESEPPGEGEVQLLESGGGLVQPGGSLKLSCAASGFTFNTYAMNWVRQAPGKGLEWVARIRSKY<br>NNYATYYADSVKDRFTISRDDSKNTAYLQMNNLKTEDTAVYYCVRHGNFGNSYVSWFAYWGQGTL<br>VTVSSGTAEAASASGSASGEPPELGAGPGSPPGSPAGSPTSTEEGTSESATPESGPGTSTEPSEG<br>SAPGSPAGSPTSTEEGTSTEPSEGSAPGTSTEPSEGSAPGTSESATPESGPGSEPATSGSETPGS<br>EPATSGSETPGSPAGSPTSTEEGTSESATPESGPGTSTEPSEGSAPGTSTEPSEGSAPGSPAGSP<br>TSTEEGTSTEPSEGSAPGTSTEPSEGSAPGTSESATPESGPGTSTEPSEGSAPGTSESATPESGP |

TABLE 15-continued

Amino acid sequences of ProTIA constructs

| Construct ID | Tumor Targets | Amino Acid Sequences |
|---|---|---|
| | | GSEPATSGSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTSTEPSEGS<br>APGTSTEPSEGSAPGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGAAEPEA<br>(SEQ ID NO.: 983) |
| AC2099 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGPPPGLTGPPGSPATSGSETPGTD<br>IQMTQSPSSLSASVGDRVTITCRASQDVNTAVAWYQQKPGKAPKLLIYSASFLYSGVPSRFSGSR<br>SGTDFTLTISSLQPEDFATYYCQQHYTTPPTFGQGTKVEIKGATPPETGAETESPGETTGGSAES<br>EPPGEGEVQLVESGGGLVQPGGSLRLSCAASGFNIKDTYTHWVRQAPGKGLEWVARTYPTNGYTR<br>YADSVKGRFTISADTSKNTAYLQMNSLRAEDTAVYYCSRWGGDGFYAMDYWGQGTLVTVSSGGGG<br>SELVVTQEPSLTVSPGGTVTLTCRSSTGAVTTSNYANWVQQKPGQAPRGLIGGTNKRAPGTPARF<br>SGSLLGGKAALTLSGVQPEDEAEYYCALWYSNLWVFGGGTKLTVLGATPPETGAETESPGETTGG<br>SAESEPPGEGEVQLLESGGGLVQPGGSLKLSCAASGFTFNTYAMNWVRQAPGKGLEWVARIRSKY<br>NNYATYYADSVKDRFTISRDDSKNTAYLQMNNLKTEDTAVYYCVRHGNFGNSYVSWFAYWGQGTL<br>VTVSSGTAEAASASGSASGPPPGLTGPPGSPPGSPAGSPTSTEEGTSESATPESGPGTSTEPSEG<br>SAPGSPAGSPTSTEEGTSTEPSEGSAPGTSTEPSEGSAPGTSESATPESGPGSEPATSGSETPGS<br>EPATSGSETPGSPAGSPTSTEEGTSESATPESGPGTSTEPSEGSAPGTSTEPSEGSAPGSPAGSP<br>TSTEEGTSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTSTEPSEGS<br>APGTSTEPSEGSAPGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGAAEPEA<br>(SEQ ID NO.: 984) |
| AC2100 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGTPAPLGGEPGSPATSGSETPGTD<br>IQMTQSPSSLSASVGDRVTITCRASQDVNTAVAWYQQKPGKAPKLLIYSASFLYSGVPSRFSGSR<br>SGTDFTLTISSLQPEDFATYYCQQHYTTPPTFGQGTKVEIKGATPPETGAETESPGETTGGSAES<br>EPPGEGEVQLVESGGGLVQPGGSLRLSCAASGFNIKDTYIHWVRQAPGKGLEWVARTYPTNGYTR<br>YADSVKGRFTISADTSKNTAYLQMNSLRAEDTAVYYCSRWGGDGFYAMDYWGQGTLVTVSSGGGG<br>SELVVTQEPSLTVSPGGTVTLTCRSSTGAVTTSNYANWVQQKPGQAPRGLIGGTNKRAPGTPARF<br>SGSLLGGKAALTLSGVQPEDEAEYYCALWYSNLWVFGGGTKLTVLGATPPETGAETESPGETTGG<br>SAESEPPGEGEVQLLESGGGLVQPGGSLKLSCAASGFTFNTYAMNWVRQAPGKGLEWVARIRSKY<br>NNYATYYADSVKDRFTISRDDSKNTAYLQMNNLKTEDTAVYYCVRHGNFGNSYVSWFAYWGQGTL<br>VTVSSGTAEAASASGSASGTPAPLGGEPGSPPGSPAGSPTSTEEGSESATPESGPGTSTEPSEG<br>SAPGSPAGSPTSTEEGTSTEPSEGSAPGTSTEPSEGSAPGTSESATPESGPGSEPATSGSETPGS<br>EPATSGSETPGSPAGSPTSTEEGTSESATPESGPGTSTEPSEGSAPGTSTEPSEGSAPGSPAGSP<br>TSTEEGTSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTSTEPSEGS<br>APGTSTEPSEGSAPGTSTEPSEGSAPGTSTEPSEGSAPGTSTEPSEGSAPGSPAGSPTSTEEGTS<br>TEPSEGSAPGTSESATPESGPGSEPATSGSETPGTSESATPESGPGSEPATSGSETPGTSESATP<br>ESGPGTSTEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGPGSEPAT<br>SGSETPGTSESATPESGPGTSTEPSEGSAPGSPAGSPTSTEEGTSESATPESGPGSEPATSGSET<br>PGTSESATPESGPGSPAGSPTSTEEGSPAGSPTSTEEGTSTEPSEGSAPGTSESATPESGPGTSE<br>SATPESGPGTSESATPESGPGSEPATSGSETPGSEPATSGSETPGSPAGSPTSTEEGTSTEPSEG<br>SAPGTSTEPSEGSAPGSEPATSGSETPGTSESATPESGPGTSTEPSEGAAEPEA<br>(SEQ ID NO.: 985) |
| AC2101 | Her2 | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSPAGPPEGLETEAGSPATSGSETPGTD |

TABLE 15-continued

Amino acid sequences of ProTIA constructs

| Construct ID | Tumor Targets | Amino Acid Sequences |
|---|---|---|
| | | IQMTQSPSSLSASVGDRVTITCRASQDVNTAVAWYQQKPGKAPKLLIYSASFLYSGVPSRFSGSR SGTDFTLTISSLQPEDFATYYCQQHYTTPPTFGQGTKVEIKGATPPETGAETESPGETTGGSAES EPPGEGEVQLVESGGGLVQPGGSLRLSCAASGFNIKDTYTHWVRQAPGKGLEWVARTYPTNGYTR YADSVKGRFTISADTSKNTAYLQMNSLRAEDTAVYYCSRWGGDGFYAMDYWGQGTLVTVSSGGGG SELVVTQEPSLTVSPGGTVTLTCRSSTGAVTTSNYANWVQQKPGQAPRGLIGGTNKRAPGTPARF SGSLLGGKAALTLSGVQPEDEAEYYCALWYSNLWVFGGGTKLTVLGATPPETGAETESPGETTGG SAESEPPGEGEVQLLESGGGLVQPGGSLKLSCAASGFTFNTYAMNWVRQAPGKGLEWVARIRSKY NNYATYYADSVKDRFTISRDDSKNTAYLQMNNLKTEDTAVYYCVRHGNFGNSYVSWFAYWGQGTL VTVSSGTAEAASASGSPAGPPEGLETEAGSPPGSPAGSPTSTEEGTSESATPESGPGTSTEPSEG SAPGSPAGSPTSTEEGTSTEPSEGSAPGTSTEPSEGSAPGTSESATPESGPGSEPATSGSETPGS EPATSGSETPGSPAGSPTSTEEGTSESATPESGPGTSTEPSEGSAPGTSTEPSEGSAPGSPAGSP TSTEEGTSTEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPESGPGSPAG SPTSTEEGTSESATPESGPGSEPATSGSETPGTSESATPESGPGTSTEPSEGSAPGTSTEPSEGS APGTSTEPSEGSAPGTSTEPSEGSAPGTSTEPSEGSAPGTSTEPSEGSAPGSPAGSPTSTEEGTS TEPSEGSAPGTSESATPESGPGSEPATSGSETPGTSESATP ESGPGTSTEPSEGSAPGTSESATPESGPGSPAGSPTSTEEGSPAGSPTSTEEGSPAGSPTSTEEG TSESATPESGPGTSTEPSEGSAPGTSESATPESGPGSEPATSGSETPGTSESATPESGPGSEPAT SGSETPGTSESATPESGPGTSTEPSEGSAPGSPAGSPTSTEEGTSESATPESGPGSEPATSGSET PGTSESATPESGPGSPAGSPTSTEEGSPAGSPTSTEEGTSTEPSEGSAPGTSESATPESGPGTSE SATPESGPGTSESATPESGPGSEPATSGSETPGSEPATSGSETPGSPAGSPTSTEEGTSTEPSEG SAPGTSTEPSEGSAPGSEPATSGSETPGTSESATPESGPGTSTEPSEGAAEPEA (SEQ ID NO.: 986) |
| AC2102 | Her2 | HHHHHHSPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEEGTSTEPSEGS APGTSESATPESGPGTSESATPESGPGSEPATSGSETPGSEPATSGSETPGSEPATSGSETPGTD AGSPTSTEEGTSTEPSEGSAPGTSTEPSEGSAPGGSAPSPTSGRGGLTGPGSEPATSGSETPGTD IQMTQSPSSLSASVGDRVTITCRASQDVNTAVAWYQQKPGKAPKLLIYSASFLYSGVPSRFSGSR SGTDFTLTISSLQPEDFATYYCQQHYTTPPTFGQGTKVEIKGATPPETGAETESPGETTGGSAES EPPGEGEVQLVESGGGLVQPGGSLRLSCAASGFNIKDTYIHWVRQAPGKGLEWVARIYPTNGYTR YADSVKGRFTISADTSKNTAYLQMNSLRAEDTAVYYCSRWGGDGFYAMDYWGQGTLVTVSSGGGG SELVVTQEPSLTVSPGGTVTLTCRSSTGAVTTSNYANWVQQKPGQAPRGLIGGTNKRAPGTPARF SGSLLGGKAALTLSGVQPEDEAEYYCALWYSNLWVFGGGTKLTVLGATPPETGAETESPGETTGG SAESEPPGEGEVQLLESGGGLVQPGGSLKLSCAASGFTFNTYAMNWVRQAPGKGLEWVARIRSKY NNYATYYADSVKDRFTISRDDSKNTAYLQMNNLKTEDTAVYYCVRHGNFGNSYVSWFAYWGQGTL VTVSSGTAEAASASGSPTSGRGGLTGPGSEPPGSPAGSPTSTEEGTSESATPESGPGTSTEPSEG SAPGSPAGSPTSTEEGTSTEPSEGSAPGTSTEPSEGSAPGTSESATPESGPGSEPATSGSETPGS EPATSGSETPGSPAGSPTSTEEGTSESATPESGPGTSTEPSEGSAPGTSTEPSEGSAPGSPAGSP TSTEEGTSTEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPESGPGSPAG SPTSTEEGTSESATPESGPGSEPATSGSETPGTSESATPESGPGTSTEPSEGSAPGTSTEPSEGS APGTSTEPSEGSAPGTSTEPSEGSAPGTSTEPSEGSAPGTSTEPSEGSAPGSPAGSPTSTEEGTS TEPSEGSAPGTSESATPESGPGSEPATSGSETPGTSESATP ESGPGTSTEPSEGSAPGTSESATPESGPGSPAGSPTSTEEGSPAGSPTSTEEGSPAGSPTSTEEG TSESATPESGPGTSTEPSEGSAPGTSESATPESGPGSEPATSGSETPGTSESATPESGPGSEPAT SGSETPGTSESATPESGPGTSTEPSEGSAPGSPAGSPTSTEEGTSESATPESGPGSEPATSGSET PGTSESATPESGPGSPAGSPTSTEEGSPAGSPTSTEEGTSTEPSEGSAPGTSESATPESGPGTSE SATPESGPGTSESATPESGPGSEPATSGSETPGSEPATSGSETPGSPAGSPTSTEEGTSTEPSEG SAPGTSTEPSEGSAPGSEPATSGSETPGTSESATPESGPGTSTEPSEGAAEPEA (SEQ ID NO.: 987) |
| AC2103 | EGFR | HHHHHHSPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEEGTSTEPSEGS APGTSESATPESGPGTSESATPESGPGTSESATPESGPGSEPATSGSETPGSEPATSGSETPGSP AGSPTSTEEGTSTEPSEGSAPGTSTEPSEGSAPGGSAPEAGRSAEATSAGATGPATSGSETPGTD IQMTQSPSSLSASVGDRVTITCQASQDISNYLNWYQQKPGKAPKLLIYDASNLETGVPSRFSGSG SGTDFTFTISSLQPEDIATYFCQHFDHLPLAFGGGTKVEIKGATPPETGAETESPGETTGGSAES EPPGEGQVQLQESGPGLVKPSETLSLTCTVSGGSVSSGDYYWTIRQSPGKGLEWIGHIYYSGNT NYNPSLKSRLTISIDTSKTQFSLKLSSVTAADTAIYYCVRDRYVGAFDIWGQGTMVTVSSGGGGS ELVVTQEPSLTVSPGGTVTLTCRSSTGAVTTSNYANWVQQKPGQAPRGLIGGTNKRAPGTPARFS GSLLGGKAALTLSGVQPEDEAEYYCALWYSNLWVFGGGTKLTVLGATPPETGAETESPGETTGGS AESEPPGEGEVQLLESGGGLVQPGGSLKLSCAASGFTFNTYAMNWVRQAPGKGLEWVARIRSKYN NYATYYADSVKDRFTISRDDSKNTAYLQMNNLKTEDTAVYYCVRHGNFGNSYVSWFAYWGQGTLV TVSSGTAEAASASGEAGRSAEATSAGATGPPGSPAGSPTSTEEGTSESATPESGPGTSTEPSEGS APGSPAGSPTSTEEGTSTEPSEGSAPGTSTEPSEGSAPGTSESATPESGPGSEPATSGSETPGSE PATSGSETPGSPAGSPTSTEEGTSESATPESGPGTSTEPSEGSAPGTSTEPSEGSAPGSPAGSPT STEEGTSTEPSEGSAPGTSTEPSEGSAPGTSESATPESGPGTSTEPSEGSAPGTSESATPESGPG SEPATSGSETPGTSTEPSEGSAPGTSTEPSEGSAPGTSESATPESGPGTSESATPESGPGSPAGS PTSTEEGTSESATPESGPGSEPATSGSETPGTSESATPESGPGTSTEPSEGSAPGTSTEPSEGSA PGTSTEPSEGSAPGTSTEPSEGSAPGTSTEPSEGSAPGTSTEPSEGSAPGSPAGSPTSTEEGTST EPSEGSAPGTSESATPESGPGSEPATSGSETPGTSESATPESGPGSEPATSGSETPGTSESATPE SGPGTSTEPSEGSAPGTSESATPESGPGSPAGSPTSTEEGSPAGSPTSTEEGSPAGSPTSTEEGT |

TABLE 15-continued

Amino acid sequences of ProTIA constructs

| Construct ID | Tumor Targets | Amino Acid Sequences |
|---|---|---|
| | | SESATPESGPGTSTEPSEGSAPGTSESATPESGPGSEPATSGSETPGTSESATPESGPGSEPATS<br>GSETPGTSESATPESGPGTSTEPSEGSAPGSPAGSPTSTEEGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSES<br>ATPESGPGTSESATPESGPGSEPATSGSETPGSEPATSGSETPGSPAGSPTSTEEGTSTEPSEGS<br>APGTSTEPSEGSAPGSEPATSGSETPGTSESATPESGPGTSTEPSEGAAEPEA<br>(SEQ ID NO.: 988) |
| AC2104 | EGFR | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPEAGESANATSAGATGPATSGSETPGTD<br>IQMTQSPSSLSASVGDRVTITCQASQDISNYLNWYQQKPGKAPKLLIYDASNLETGVPSRFSGSG<br>SGTDFTFTISSLQPEDIATYFCQHFDHLPLAFGGGTKVEIKGATPPETGAETESPGETTGGSAES<br>EPPGEGQVQLQESGPGLVKPSETLSLTCTVSGGSVSSGDYYWTIRQSPGKGLEWIGHIYYSGNT<br>NYNPSLKSRLTISIDTSKTQFSLKLSSVTAADTAIYYCVRDRVTGAFDIWGQGTMVTVSSGGGGS<br>ELVVTQEPSLTVSPGGTVTLTCRSSTGAVTTSNYANWVQQKPGQAPRGLIGGTNKRAPGTPARFS<br>GSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLV<br>TVSSGTAEAASASGEAGESANATSAGATGPPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSE<br>PATSGSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPE<br>SGPGTSTEPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATSGSETPGTSESATPESGPGSEPATS<br>GSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSES<br>ATPESGPGTSESATPESGPGSEPATSGSETPGSEPATSGSETPGSPAGSPTSTEEGTSTEPSEGS<br>APGTSTEPSEGSAPGSEPATSGSETPGTSESATPESGPGTSTEPSEGAAEPEA<br>(SEQ ID NO.: 989) |
| AC2105 | EGFR | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPEAGESAGATPAGLTGPATSGSETPGTD<br>IQMTQSPSSLSASVGDRVTITCQASQDISNYLNWYQQKPGKAPKLLIYDASNLETGVPSRFSGSG<br>SGTDFTFTISSLQPEDIATYFCQHFDHLPLAFGGGTKVEIKGATPPETGAETESPGETTGGSAES<br>EPPGEGQVQLQESGPGLVKPSETLSLTCTVSGGSVSSGDYYWTIRQSPGKGLEWIGHIYYSGNT<br>NYNPSLKSRLTISIDTSKTQFSLKLSSVTAADTAIYYCVRDRVTGAFDIWGQGTMVTVSSGGGGS<br>ELVVTQEPSLTVSPGGTVTLTCRSSTGAVTTSNYANWVQQKPGQAPRGLIGGTNKRAPGTPARFS<br>GSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLV<br>TVSSGTAEAASASGEAGESAGATPAGLTGPPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSE<br>PATSGSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPE<br>SGPGTSTEPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATSGSETPGTSESATPESGPGSEPATS<br>GSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSES<br>ATPESGPGTSESATPESGPGSEPATSGSETPGSEPATSGSETPGSPAGSPTSTEEGTSTEPSEGS<br>APGTSTEPSEGSAPGSEPATSGSETPGTSESATPESGPGTSTEPSEGAAEPEA<br>(SEQ ID NO.: 990) |
| AC2106 | EGFR | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGTYSRGESGPGSPATSGSETPGTD<br>IQMTQSPSSLSASVGDRVTITCQASQDISNYLNWYQQKPGKAPKLLIYDASNLETGVPSRFSGSG<br>SGTDFTFTISSLQPEDIATYFCQHFDHLPLAFGGGTKVEIKGATPPETGAETESPGETTGGSAES<br>EPPGEGQVQLQESGPGLVKPSETLSLTCTVSGGSVSSGDYYWTIRQSPGKGLEWIGHIYYSGNT<br>NYNPSLKSRLTISIDTSKTQFSLKLSSVTAADTAIYYCVRDRVTGAFDIWGQGTMVTVSSGGGGS<br>ELVVTQEPSLTVSPGGTVTLTCRSSTGAVTTSNYANWVQQKPGQAPRGLIGGTNKRAPGTPARFS |

TABLE 15-continued

Amino acid sequences of ProTIA constructs

| Construct ID | Tumor Targets | Amino Acid Sequences |
|---|---|---|
| | | GSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLV<br>TVSSGTAEAASASGSASGTYSRGESGPGSPPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSE<br>PATSGSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGSPAGSPTSTEEGTST<br>EPSEGSAPGTSESATPESGPGSEPATSGSETPGTSESATPE<br>SGPGTSTEPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATSGSETPGTSESATPESGPGSEPATS<br>GSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSES<br>ATPESGPGTSESATPESGPGSEPATSGSETPGSEPATSGSETPGSPAGSPTSTEEGTSTEPSEGS<br>APGTSTEPSEGSAPGSEPATSGSETPGTSESATPESGPGTSTEPSEGAAEPEA<br>(SEQ ID NO.: 991) |
| AC2107 | EGFR | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGAEGRTDTHPGSPATSGSETPGTD<br>IQMTQSPSSLSASVGDRVTITCQASQDISNYLNWYQQKPGKAPKLLIYDASNLETGVPSRFSGSG<br>SGTDFTFTISSLQPEDIATYFCQHFDHLPLAFGGGTKVEIKGATPPETGAETESPGETTGGSAES<br>EPPGEGQVQLQESGPGLVKPSETLSLTCTVSGGSVSSGDYYWTWIRQSPGKGLEWIGHIYYSGNT<br>NYNPSLKSRLTISIDTSKTQFSLKLSSVTAADTAIYYCVRDRVTGAFDIWGQGTMVTVSSGGGGS<br>ELVVTQEPSLTVSPGGTVTLTCRSSTGAVTTSNYANWVQQKPGQAPRGLIGGTNKRAPGTPARFS<br>GSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLV<br>TVSSGTAEAASASGSASGAEGRTDTHPGSPPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSE<br>PATSGSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGSPAGS<br>PTSTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPE<br>SGPGTSTEPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATS<br>GSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSES<br>ATPESGPGTSESATPESGPGSEPATSGSETPGSEPATSGSETPGSPAGSPTSTEEGTSTEPSEGS<br>APGTSTEPSEGSAPGSEPATSGSETPGTSESATPESGPGTSTEPSEGAAEPEA<br>(SEQ ID NO.: 992) |
| AC2108 | EGFR | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGEPGRAAEHPGSPATSGSETPGTD<br>IQMTQSPSSLSASVGDRVTITCQASQDISNYLNWYQQKPGKAPKLLIYDASNLETGVPSRFSGSG<br>SGTDFTFTISSLQPEDIATYFCQHFDHLPLAFGGGTKVEIKGATPPETGAETESPGETTGGSAES<br>EPPGEGQVQLQESGPGLVKPSETLSLTCTVSGGSVSSGDYYWTWIRQSPGKGLEWIGHIYYSGNT<br>NYNPSLKSRLTISIDTSKTQFSLKLSSVTAADTAIYYCVRDRVTGAFDIWGQGTMVTVSSGGGGS<br>ELVVTQEPSLTVSPGGTVTLTCRSSTGAVTTSNYANWVQQKPGQAPRGLIGGTNKRAPGTPARFS<br>GSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLV<br>TVSSGTAEAASASGSASGEPGRAAEHPGSPPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSE<br>PATSGSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPE<br>SGPGTSTEPSEGSAPGTSESATPESGPGSPAGSPTSTEEGSPAGSPTSTEEGSPAGSPTSTEEGT |

TABLE 15-continued

Amino acid sequences of ProTIA constructs

| Construct ID | Tumor Targets | Amino Acid Sequences |
|---|---|---|
| | | SESATPESGPGTSTEPSEGSAPGTSESATPESGPGSEPATSGSETPGTSESATPESGPGSEPATS<br>GSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSES<br>ATPESGPGSEPATSGSETPGSEPATSGSETPGSEPAGSPTSTEEGTSTEPSEGS<br>APGTSTEPSEGSAPGSEPATSGSETPGTSESATPESGPGTSTEPSEGAAEPEA<br>(SEQ ID NO.: 993) |
| AC2109 | EGFR | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSPAGESSRGTTIAGSPATSGSETPGTD<br>IQMTQSPSSLSASVGDRVTITCQASQDISNYLNWYQQKPGKAPKLLIYDASNLETGVPSRFSGSG<br>SGTDFTFTISSLQPEDIATYFCQHFDHLPLAFGGGTKVEIKGATPPETGAETESPGETTGGSAES<br>EPPGEGQVQLQESGPGLVKPSETLSLTCTVSGGSVSSGDYYWTWIRQSPGKGLEWIGHIYYSGNT<br>NYNPSLKSRLTISIDTSKTQFSLKLSSVTAADTAIYYCVRDRVTGAFDIWGQGTMVTVSSGGGGS<br>ELVVTQEPSLTVSPGGTVTLTCRSSTGAVTTSNYANWVQQKPGQAPRGLIGGTNKRAPGTPARFS<br>GSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLV<br>TVSSGTAEAASASGSPAGESSRGTTIAGSPPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSE<br>PATSGSETPGSPAGSPTSTEEGTSESATPESGPGTSTEPSEGSAPGTSTEPSEGSAPGSPAGSPT<br>STEEGTSTEPSEGSAPGTSTEPSEGSAPGTSTEPSEGSAPGTSESATPESGPGTSTEPSEGSAPG<br>SEPATSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPE<br>SGPGTSTEPSEGSAPGTSESATPESGPGSPAGSPTSTEEGSPAGSPTSTEEGT<br>SESATPESGPGTSTEPSEGSAPGTSESATPESGPGSEPATSGSETPGTSESATPESGPGSEPATS<br>GSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSES<br>ATPESGPGTSESATPESGPGSEPATSGSETPGSEPATSGSETPGSPAGSPTSTEEGTSTEPSEGS<br>APGTSTEPSEGSAPGSEPATSGSETPGTSESATPESGPGTSTEPSEGAAEPEA<br>(SEQ ID NO.: 994) |
| AC2110 | EGFR | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGEPPELGAGPGSPATSGSETPGTD<br>IQMTQSPSSLSASVGDRVTITCQASQDISNYLNWYQQKPGKAPKLLIYDASNLETGVPSRFSGSG<br>SGTDFTFTISSLQPEDIATYFCQHFDHLPLAFGGGTKVEIKGATPPETGAETESPGETTGGSAES<br>EPPGEGQVQLQESGPGLVKPSETLSLTCTVSGGSVSSGDYYWTWIRQSPGKGLEWIGHIYYSGNT<br>NYNPSLKSRLTISIDTSKTQFSLKLSSVTAADTAIYYCVRDRVTGAFDIWGQGTMVTVSSGGGGS<br>ELVVTQEPSLTVSPGGTVTLTCRSSTGAVTTSNYANWVQQKPGQAPRGLIGGTNKRAPGTPARFS<br>GSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLV<br>TVSSGTAEAASASGSASGEPPELGAGPGSPPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSE<br>PATSGSETPGSPAGSPTSTEEGTSESATPESGPGTSTEPSEGSAPGTSTEPSEGSAPGSPAGSPT<br>STEEGTSTEPSEGSAPGTSTEPSEGSAPGTSTEPSEGSAPGTSESATPESGPGTSTEPSEGSAPG<br>SEPATSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPE<br>SGPGTSTEPSEGSAPGTSESATPESGPGSPAGSPTSTEEGSPAGSPTSTEEGT<br>SESATPESGPGTSTEPSEGSAPGTSESATPESGPGSEPATSGSETPGTSESATPESGPGSEPATS<br>GSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSES<br>ATPESGPGTSESATPESGPGSEPATSGSETPGSEPATSGSETPGSPAGSPTSTEEGTSTEPSEGS<br>APGTSTEPSEGSAPGSEPATSGSETPGTSESATPESGPGTSTEPSEGAAEPEA<br>(SEQ ID NO.: 995) |
| AC2111 | EGFR | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGPPPGLTGPPGSPATSGSETPGTD<br>IQMTQSPSSLSASVGDRVTITCQASQDISNYLNWYQQKPGKAPKLLIYDASNLETGVPSRFSGSG<br>SGTDFTFTISSLQPEDIATYFCQHFDHLPLAFGGGTKVEIKGATPPETGAETESPGETTGGSAES<br>EPPGEGQVQLQESGPGLVKPSETLSLTCTVSGGSVSSGDYYWTWIRQSPGKGLEWIGHIYYSGNT<br>NYNPSLKSRLTISIDTSKTQFSLKLSSVTAADTAIYYCVRDRVTGAFDIWGQGTMVTVSSGGGGS<br>ELVVTQEPSLTVSPGGTVTLTCRSSTGAVTTSNYANWVQQKPGQAPRGLIGGTNKRAPGTPARFS |

TABLE 15-continued

Amino acid sequences of ProTIA constructs

| Construct ID | Tumor Targets | Amino Acid Sequences |
|---|---|---|
| | | GSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLV<br>TVSSGTAEAASASGSASGPPPGLTGPPGSPPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSE<br>PATSGSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPE<br>SGPGTSTEPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATSGSETPGTSESATPESGPGSEPATS<br>GSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSES<br>ATPESGPGTSESATPESGPGSEPATSGSETPGSEPATSGSETPGSPAGSPTSTEEGTSTEPSEGS<br>APGTSTEPSEGSAPGSEPATSGSETPGTSESATPESGPGTSTEPSEGAAEPEA<br>(SEQ ID NO.: 996) |
| AC2112 | EGFR | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSASGTPAPLGGEPGSPATSGSETPGTD<br>IQMTQSPSSLSASVGDRVTITCQASQDISNYLNWYQQKPGKAPKLLIYDASNLETGVPSRFSGSG<br>SGTDFTFTISSLQPEDIATYFCQHFDHLPLAFGGGTKVEIKGATPPETGAETESPGETTGGSAES<br>EPPGEGQVQLQESGPGLVKPSETLSLTCTVSGGSVSSGDYYNTWIRQSPGKGLEWIGHTYYSGNT<br>NYNPSLKSRLTISIDTSKTQFSLKLSSVTAADTAIYYCVRDRVTGAFDINGQGTMVTVSSGGGGS<br>ELVVTQEPSLTVSPGGTVTLTCRSSTGAVTTSNYANWVQQKPGQAPRGLIGGTNKRAPGTPARFS<br>GSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLV<br>TVSSGTAEAASASGSASGTPAPLGGEPGSPPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSE<br>PATSGSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPE<br>SGPGTSTEPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATSGSETPGTSESATPESGPGSEPATS<br>GSETPGTSESATPESGPGTSTEPSEGSAPGSPAGSPTSTEEGTSESATPESGPGSEPATSGSETP<br>GTSESATPESGPGSPAGSPTSTEEGSPAGSPTSTEEGTSTEPSEGSAPGTSESATPESGPGTSES<br>ATPESGPGTSESATPESGPGSEPATSGSETPGSEPATSGSETPGSPAGSPTSTEEGTSTEPSEGS<br>APGTSTEPSEGSAPGSEPATSGSETPGTSESATPESGPGTSTEPSEGAAEPEA<br>(SEQ ID NO.: 997) |
| AC2113 | EGFR | HHHHHHSPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSETPGSP<br>AGSPTSTEEGTSTEPSEGSAPGTSTEPSEGSAPGGSAPSPAGPPEGLETEAGSPATSGSETPGTD<br>IQMTQSPSSLSASVGDRVTITCQASQDISNYLNWYQQKPGKAPKLLIYDASNLETGVPSRFSGSG<br>SGTDFTFTISSLQPEDIATYFCQHFDHLPLAFGGGTKVEIKGATPPETGAETESPGETTGGSAES<br>EPPGEGQVQLQESGPGLVKPSETLSLTCTVSGGSVSSGDYYNTWIRQSPGKGLEWIGHTYYSGNT<br>NYNPSLKSRLTISIDTSKTQFSLKLSSVTAADTAIYYCVRDRVTGAFDINGQGTMVTVSSGGGGS<br>ELVVTQEPSLTVSPGGTVTLTCRSSTGAVTTSNYANWVQQKPGQAPRGLIGGTNKRAPGTPARFS<br>GSLLGGKAALTLSGVQPEDEAEYYCALWYSNLWVFGGGTKLTVLGATPPETGAETESPGETTGGS<br>AESEPPGEGEVQLLESGGGLVQPGGSLKLSCAASGFTFNTYAMNWVRQAPGKGLEWVARIRSKYN<br>NYATYYADSVKDRFTISRDDSKNTAYLQMNNLKTEDTAVYYCVRHGNFGNSYVSWFAYWGQGTLV<br>TVSSGTAEAASASGSAGPPEGLETEAGSPPGSPAGSPTSTEEGTSESATPESGPGTSTEPSEGS<br>APGSPAGSPTSTEEGTSTEPSEGSAPGTSTEPSEGSAPGTSESATPESGPGSEPATSGSETPGSE<br>PATSGSETPGSPAGSPTSTEEGTSESATPESGPGTSTEPSEGSAPGTSTEPSEGSAPGSPAGSPT<br>STEEGTSTEPSEGSAPGTSTEPSEGSAPGTSESATPESGPGTSTEPSEGSAPGTSESATPESGPG<br>SEPATSGSETPGTSTEPSEGSAPGTSTEPSEGSAPGTSESATPESGPGTSESATPESGPGSPAGS<br>PTSTEEGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGTSTEPSEGSAPGSPAGSPTSTEEGTST<br>EPSEGSAPGTSESATPESGPGSEPATSGSETPGTSESATPESGPGSEPATSGSETPGTSESATPE<br>SGPGTSTEPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATSGSETPGTSESATPESGPGSEPATS |

TABLE 15-continued

Amino acid sequences of ProTIA constructs

| Construct ID | Tumor Targets | Amino Acid Sequences |
|---|---|---|
| | | GSETPGTSESATPESGPGTSTEPSEGSAPGSPAGSPTSTEEGTSESATPESGPGSEPATSGSETP GTSESATPESGPGSPAGSPTSTEEGSPAGSPTSTEEGTSTEPSEGSAPGTSESATPESGPGTSES ATPESGPGTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGAAEPEA (SEQ ID NO.: 998) |
| AC2114 | EGFR | HHHHHHSPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEEGTSTEPSEGS APGTSESATPESGPGTSESATPESGPGTSESATPESGPGSEPATSGSETPGSEPATSGSETPGSP AGSPTSTEEGTSTEPSEGSAPGTSTEPSEGSAPGGSAPSPTSGRGGLTGPGSEPATSGSETPGTD IQMTQSPSSLSASVGDRVTITCQASQDISNYLNWYQQKPGKAPKLLIYDASNLETGVPSRFSGSG SGTDFTFTISSLQPEDIATYFCQHFDHLPLAFGGGTKVEIKGATPPETGAETESPGETTGGSAES EPPGEGQVQLQESGPGLVKPSETLSLTCTVSGGSVSSGDYYNTWIRQSPGKGLEWIGHTYYSGNT NYNPSLKSRLTISIDTSKTQFSLKLSSVTAADTAIYYCVRDRVTGAFDINGQGTMVTVSSGGGGS ELVVTQEPSLTVSPGGTVTLTCRSSTGAVTTSNYANWVQQKPGQAPRGLIGGTNKRAPGTPARFS GSLLGGKAALTLSGVQPEDEAEYYCALWYSNLWVFGGGTKLTVLGATPPETGAETESPGETTGGS AESEPPGEGEVQLLESGGGLVQPGGSLKLSCAASGFTFNTYAMNWVRQAPGKGLEWVARIRSKYN NYATYYADSVKDRFTISRDDSKNTAYLQMNNLKTEDTAVYYCVRHGNFGNSYVSWFAYWGQGTLV TVSSGTAEAASASGSPTSGRGGLTGPGSEPPGSPAGSPTSTEEGTSESATPESGPGTSTEPSEGS APGSPAGSPTSTEEGTSTEPSEGSAPGTSTEPSEGSAPGTSESATPESGPGSEPATSGSETPGSE PATSGSETPGSPAGSPTSTEEGTSESATPESGPGTSTEPSEGSAPGTSTEPSEGSAPGSPAGSPT STEEGTSTEPSEGSAPGTSTEPSEGSAPGTSESATPESGPGTSTEPSEGSAPGTSESATPESGPG SEPATSGSETPGTSTEPSEGSAPGTSTEPSEGSAPGTSESATPESGPGTSESATPESGPGSPAGS PTSTEEGTSESATPESGPGSEPATSGSETPGTSESATPESGPGTSTEPSEGSAPGTSTEPSEGSA PGTSTEPSEGSAPGTSTEPSEGSAPGTSTEPSEGSAPGTSTEPSEGSAPGSPAGSPTSTEEGTST EPSEGSAPGTSESATPESGPGSEPATSGSETPGTSESATPESGPGSEPATSGSETPGTSESATPE SGPGTSTEPSEGSAPGTSESATPESGPGSPAGSPTSTEEGSPAGSPTSTEEGSPAGSPTSTEEGT SESATPESGPGTSTEPSEGSAPGTSESATPESGPGSEPATSGSETPGTSESATPESGPGSEPATS GSETPGTSESATPESGPGTSTEPSEGSAPGSPAGSPTSTEEGTSESATPESGPGSEPATSGSETP GTSESATPESGPGSPAGSPTSTEEGSPAGSPTSTEEGTSTEPSEGSAPGTSESATPESGPGTSES ATPESGPGTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGAAEPEA (SEQ ID NO.: 999) |

Example 39: Construction of XTEN Base Vector with Release Segment RSR-1517

The XTEN base vector AC1611 with Release Segment RSR-1517 (amino acid sequence EAGRSANHEPLGLVAT (SEQ ID NO.:1)) was built from modifying pNL0356 by PCR to encode the protein of HD2-V5-XTENT44-RSR-1517-XTEN712-H8 under the control of T7lac promoter, where HD2 sequence is MKNPEQAEEQAEEQREET (SEQ ID NO.: 1000) and V5 is GKPIPNPLLGLDST (SEQ ID NO.: 1001). The coding sequence of release segment RSR-1517 on AC1611 is flanked by unique NheI and BsaI restriction sites to enable replacement with another release segments. After ligation reaction, transformants were screened by DNA miniprep and the desired construct was confirmed by DNA sequencing. The resulting construct is AC1611, with the DNA sequence and encoded amino acid sequence provided in Table 16.

TABLE 16

DNA and amino acid sequence of AC1611 XTEN with Release Segment

| Construct Name | DNA Sequence | Amino Acid Sequence* |
|---|---|---|
| AC1611 | ATGAAAAACCCAGAGCAAGCAGAAGAACAAGCTGAAGAACAGCGCGAA | MKNPEQAEEQAEEQREE |
| | GAAACAGGCAAACCGATTCCGAACCCGCTGCTGGGTCTGGATAGCACC | TGKPIPNPLLGLDSTEG |
| | GAAGGTACTAGCACGGAGCCGAGCGAGGGTAGTGCTCCGGGTACGAGC | TSTEPSEGSAPGTSESA |
| | GAGAGCGCAACGCCAGAGAGCGGTCCAGGCACCAGCGAATCGGCCACC | TPESGPGTSESATPESG |
| | CCTGAGAGCGGCCCAGGTACTTCTGAGAGCGCCACTCCTGAATCCGGC | PGTSESATPESGPGSEP |
| | CCTGGTAGCGAGCCGGCAACCTCCGGCTCAGAAACTCCTGGTTCGGAA | ATSGSETPGSEPATSGS |
| | CCAGCGACCAGCGGTTCTGAAACTCCGGGTAGCCCGGCAGGCAGCCCA | ETPGSPAGSPTSTEEGT |
| | ACGAGCACCGAAGAGGGTACCAGCACGGAACCGAGCGAGGGTTCTGCC | STEPSEGSAPGTSTEPS |
| | CCGGGTACTTCCACCGAACCATCGGAGGGCTCTGCACCTGGTAGCGAA | EGSAPGSEPATSGSETP |
| | CCTGCGACGTCTGGTTCTGAAACGCCGGGTACCAGCGAAAGCGCTACC | GTSESATPESGPGTAEA |
| | CCAGAATCCGGTCCGGGCACCGCCGAAGCAGCTAGCGCCTCTGGCGAG | ASASGEAGRSANHEPLG |
| | GCAGGTCGTTCTGCTAACCATGAACCACTGGGTCTGGTTGCTACGCCA | LVATPGSPAGSPTSTEE |
| | GGTAGCCCAGCTGGTAGCCCAACCTCTACCGAAGAAGGTACCTCTGAA | GTSESATPESGPGTSTE |
| | TCCGCTACTCCAGAATCCGGTCCTGGTACTAGCACTGAGCCAAGCGAA | PSEGSAPGSPAGSPTST |
| | GGTTCTGCTCCAGGCTCCCCGGCAGGTAGCCCTACCTCTACCGAAGAG | EEGTSTEPSEGSAPGTS |
| | GGCACTAGCACCGAACCATCTGAGGGTTCCGCTCCTGGCACCTCCACT | TEPSEGSAPGTSESATP |
| | GAACCGTCCGAAGGCAGTGCTCCGGGTACTTCCGAAAGCGCAACTCCG | ESGPGSEPATSGSETPG |
| | GAATCCGGCCCTGGTTCTGAGCCTGCTACTTCCGGCTCTGAAACTCCA | SEPATSGSETPGSPAGS |
| | GGTAGCGAGCCAGCGACTTCTGGTTCTGAAACTCCAGGTTCACCGGCG | PTSTEEGTSESATPESG |

TABLE 16-continued

DNA and amino acid sequence of AC1611 XTEN with Release Segment

| Construct Name | DNA Sequence | Amino Acid Sequence* |
|---|---|---|
| | GGTAGCCCGACGAGCACGGAGGAAGGTACCTCTGAGTCGGCCACTCCT | PGTSTEPSEGSAPGTST |
| | GAGTCCGGTCCGGGCACGAGCACCGAGCCGAGCGAGGGTTCAGCCCCG | EPSEGSAPGSPAGSPTS |
| | GGTACCAGCACGGAGCCGTCCGAGGGTAGCGCACCGGGTTCTCCGGCG | TEEGTSTEPSEGSAPGT |
| | GGCTCCCCTACGTCTACGGAAGAGGGTACGTCCACTGAACCTAGCGAG | STEPSEGSAPGTSESAT |
| | GGCAGCGCGCCAGGCACCAGCACTGAACCGAGCGAAGGCAGCGCACCT | PESGPGTSTEPSEGSAP |
| | GGCACTAGCGAGTCTGCGACTCCGGAGAGCGGTCCGGGTACGAGCACG | GTSESATPESGPGSEPA |
| | GAACCAAGCGAAGGCAGCGCCCCAGGTACCTCTGAATCTGCTACCCCA | TSGSETPGTSTEPSEGS |
| | GAATCTGGCCCGGGTTCCGAGCCAGCTACCTCTGGTTCTGAAACCCCA | APGTSTEPSEGSAPGTS |
| | GGTACTTCCACTGAACCAAGCGAAGGTAGCGCTCCTGGCACTTCTACT | ESATPESGPGTSESATP |
| | GAACCATCCGAAGGTTCCGCTCCTGGTACGTCTGAAAGCGCTACCCCT | ESGPGSPAGSPTSTEEG |
| | GAAAGCGGCCCAGGCACCTCTGAAAGCGCTACTCCTGAGAGCGGTCCA | TSESATPESGPGSEPAT |
| | GGCTCTCCAGCAGGTTCTCCAACCTCCACTGAAGAAGGCACCTCTGAG | SGSETPGTSESATPESG |
| | TCTGCTACCCCTGAATCTGGTCCTGGCTCCGAACCTGCTACCTCTGGT | PGTSTEPSEGSAPGTST |
| | TCCGAAACTCCAGGTACCTCGGAATCTGCGACTCCGGAATCTGGCCCG | EPSEGSAPGTSTEPSEG |
| | GGCACGAGCACGGAGCCGTCTGAGGGTAGCGCACCAGGTACCAGCACT | SAPGTSTEPSEGSAPGT |
| | GAGCCTTCTGAGGGCTCTGCACCGGGTACCTCCACGGAACCTTCGGAA | STEPSEGSAPGTSTEPS |
| | GGTTCTGCGCCGGGTACCTCCACTGAGCCATCCGAGGGTTCAGCACCA | EGSAPGSPAGSPTSTEE |
| | GGTACTAGCACGGAACCGTCCGAGGGCTCTGCACCAGGTACGAGCACC | GTSTEPSEGSAPGTSES |
| | GAACCGTCGGAGGGTAGCGCTCCAGGTAGCCCAGCGGGCTCTCCGACA | ATPESGPGSEPATSGSE |
| | AGCACCGAAGAAGGCACCAGCCAGCCGTCCGAAGGTTCCGCACCA | TPGTSESATPESGPGSE |
| | GGTACAAGCGAGAGCGCGACTCCTGAATCTGGTCCGGGTAGCGAGCCT | PATSGSETPGTSESATP |
| | GCAACCAGCGGTTCTGAGACGCCGGGCACTTCCGAATCTGCGACCCCG | ESGPGTSTEPSEGSAPG |
| | GAGTCCGGTCCAGGTTCAGAGCCGGCGACGAGCGGTTCGGAAACGCCG | TSESATPESGPGSPAGS |
| | GGTACGTCTGAATCAGCCACGCCGGAGTCTGGTCCGGGTACCTCGACC | PTSTEEGSPAGSPTSTE |
| | GAACCAAGCGAAGGTTCGGCACCGGGTACTAGCGAGAGCGCAACCCCT | EGSPAGSPTSTEEGTSE |
| | GAAAGCGGTCCGGGCAGCCCGGCAGGTTCTCCAACCAGCACCGAAGAA | SATPESGPGTSTEPSEG |
| | GGTTCCCCTGCTGGTAGCCCGACCTCTACGGAGGAAGGTAGCCCTGCA | SAPGTSESATPESGPGS |
| | GGTTCCCCAACTTCTACTGAGGAAGGTACTTCTGAGTCCGCTACCCCA | EPATSGSETPGTSESAT |
| | GAAAGCGGTCCTGGTACCTCCACTGAACCGTCTGAAGGCTCTGCACCA | PESGPGSEPATSGSETP |
| | GGCACTTCTGAGTCTGCTACTCCAGAAAGCGGCCCAGGTTCTGAACCA | GTSESATPESGPGTSTE |
| | GCAACTTCTGGCTCTGAGACTCCAGGCACTTCTGAGTCCGCAACGCCT | PSEGSAPGSPAGSPTST |
| | GAATCCGGTCCTGGTTCTGAACACGCTACTTCCGGCAGCGAAACCCCA | EEGTSESATPESGPGSE |
| | GGTACCTCTGAGTCTGCGACTCCAGAGTCTGGTCCTGGTACTTCCACT | PATSGSETPGTSESATP |
| | GAGCCTAGCGAGGGTTCCGCACCAGGTTCTCCGGCTGGTAGCCCGACC | ESGPGSPAGSPTSTEEG |
| | AGCACGGAGGAGGGTACGTCTGAATCTGCAACGCCGGAATCGGGCCCA | SPAHHHHHHHH |
| | GGTTCGGAGCCTGCAACGTCTGGCAGCGAAACCCCGGGTACCTCCGAA | (SEQ ID NO.: 1002) |
| | TCTGCTACACCGGAAAGCGGTCCTGGCAGCCCTGCTGGTTCTCCAACC | |
| | TCTACCGAGGAGGGTTCACCGGCACATCACCATCACCACCATCATCAC | |
| | (SEQ ID NO.: 1002) | |

Example 40: Shake Flask Expression of Release Segment-XTEN Variants

The Release Segment-XTEN variant constructs were transformed into *E. coli* BL21_DE3 strain (New England Biolabs) to be expressed under the control of a T7 promotor. Starter cultures were prepared by inoculating glycerol stocks of *E. coli* BL21_DE3 carrying the corresponding plasmids into 6 mL of LB Broth media containing 50 µg/mL kanamycin and incubated overnight at 37° C. at 200 min-1. Overnight starter cultures were inoculated 1:50 into approximately 250 mL of ZY auto-induction media and grown at 26° C. for 26 hours, at 200 min-1. Cells were then harvested by centrifugation at 10,000 rpm for 30 mins for immediate use or frozen at −80° C. until use.

The ZY auto-induction media were made by mixing the components as follows: 928 mL of ZY media (10 g bacto tryptone, 5 g yeast extract and 925 mL of water; autoclaved), 1 mL 1M MgSO4, 20 mL 50× 5052 solution (25 g glycerol, 2.5 g glucose (Fisher FLBP350-1), 10 g a-lactose (Sigma L3625), and 73 ml water; sterile-filtered), 50 ml 20×NPS solution (to make 100 mL, dissolve 6.6 g (NH4)2SO4, 13.6 g KH2PO4, 14.2 g Na2HPO4 in 90 mL water; sterile-filtered) and 1 mL kanamycin (50 mg/mL).

Example 41: Purification of Release Segment-XTEN Variants from *E. coli* Shake Flask Cultures 1) Lysis, Clarification and Titer Analysis Cell pellets were resuspended 1:4 in 50 mM citrate, pH 4.0. The resuspended cells were heated to 80° C. for 15 minutes, followed by immediate cooling on ice for 30 minutes. The lysate was then clarified by centrifugation at 4,000 rpm for 40 min at 4° C. Supernatant was collected and 0.2 µm filtered.

The titer of each construct was estimated by analyzing 5 µL clarified lysate with a regular non-reducing SDS-PAGE using NuPAGE 4-12% Bis-Tris gel from Invitrogen according to manufacturer's specifications with Coomassie staining. FIG. 74A is an exemplary titer analysis of 3 RS variants and the arrow indicates where the products migrate, with apparent molecular weight roughly around the 160 kDa molecular weight marker.

2) Single-Step IMAC Purification

Immobilized-metal affinity chromatography (IMAC) was used as the capture step. For each variant, a 10-mL polypropylene column (Thermo Scientific) was packed with 5 mL of ToyoPearl-AF-Chelate 650M resin (TOSOH Biosciences). The column was equilibrated with 5 column volumes (CVs) of equilibration buffer (20 mM Tris, 100 mM NaCl, pH 7.5). The pH of the clarified cell lysates was adjusted to 7.5 before loading to the columns. After loading is completed, the column is washed with 3 CVs of equilibration buffer before eluted with 3CVs of 20 mM Tris pH 7.5, 100 mM NaCl, 100 mM imidazole. 1 CV fractions (5 mL) were collected.

The load, flowthrough, and elutions were analyzed by non-reducing 4-12% Bis-Tris SDS-PAGE and Coomassie staining to determine fractions with the eluted protein and their purity, as shown in FIG. 74B (AC1602, AC1609, and AC1610), FIG. 74C (AC1604, AC1608, AC1611), and FIG. 74D (AC1612, AC1649, AC1650).

3) HPLC Quantification and Lot Release

Figures 74, 74E:
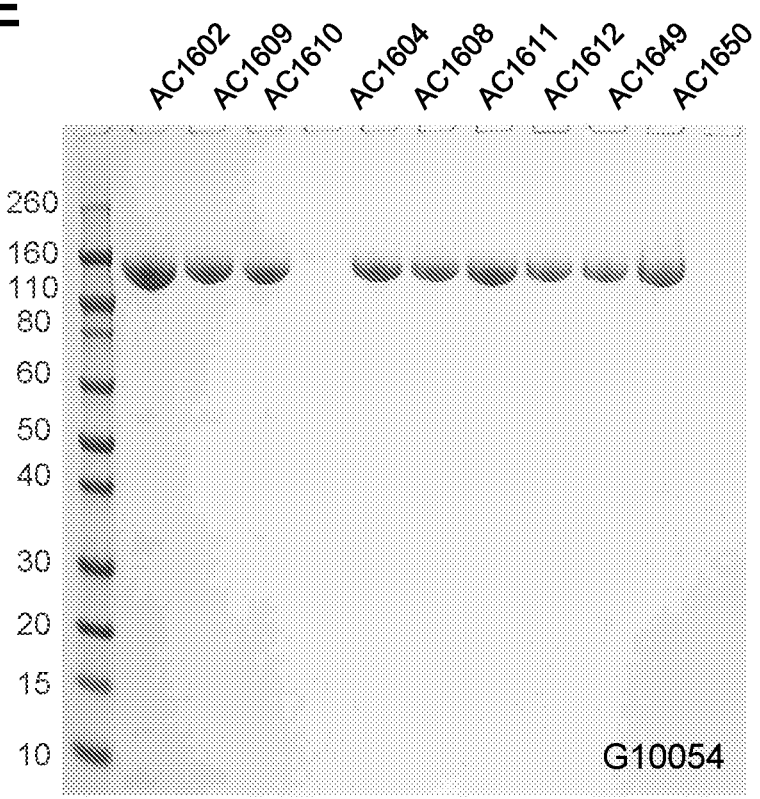
FIG. 74 shows SDS-PAGE gels from the production of release segment-XTEN variants, as described in Example 41.
FIG. 74E is the gel from the lot release of the purified RS-XTEN variants.

The aforementioned single-step IMAC purified variants were analyzed side-by-side on non-reducing 4-12% Bis-Tris SDS-PAGE (FIG. 74E). The purity was deemed sufficient for enzymatic screening and the concentration of each variant was assessed by running reverse-phase HPLC and quantified with a standard curve of a compound with known concentration.

Conclusions: We demonstrated that expression of various RS-XTEN constructs in *E. coli* is feasible and single-step IMAC purification is sufficient to produce these variants with adequate quantity and quality for subsequent enzymatic screening assay.

Example 42: Enzyme Activation, Storage and Digestion of RSR-1517-Containing XTEN AC1611

This example demonstrates that RSR-1517-containing XTEN constructs AC1611, can be cleaved by various tumor-associated proteases including recombinant human uPA, matriptase, legumain, MMP-2, MMP-7, MMP-9, and MMP-14, in test tubes.

1. Enzyme Activation

All enzymes used were obtained from R&D Systems. Recombinant human u-plasminogen activator (uPA) and recombinant human matriptase were provided as activated enzymes and stored at −80° C. until use. Recombinant mouse MMP-2, recombinant human MMP-7, and recombinant mouse MMP-9 were supplied as zymogens and required activation by 4-aminophenylmercuric acetate (APMA). APMA was first dissolved in 0.1M NaOH to a final concentration of 10 mM before the pH was readjusted to neutral using 0.1M HCl. Further dilution of the APMA stock to 2.5 mM was done in 50 mM Tris pH 7.5, 150 mM NaCl, 10 mM $CaCl_2$). To activate pro-MMP, 1 mM APMA and 100 µg/mL of pro-MMP in 50 mM Tris pH 7.5, 150 mM NaCl, 10 mM $CaCl_2$) were incubated at 37° C. for 1 hour (MMP-2, MMP-7) or 24 hours (MMP-9). To activate MMP-14, 0.86 µg/mL recombinant human furin and 40 µg/mL pro-MMP-14 in 50 mM Tris pH 9, 1 mM CaCl2) were incubated at 37° C. for 1.5 hours. To activate legumain, 100 µg/mL pro-legumain in 50 mM sodium acetate pH 4, 100 mM NaCl were incubated at 37° C. for 2 hours. 100% Ultrapure glycerol were added to all activated enzymes (including uPA and MTSP1) to a final concentration of 50% glycerol, then be stored at −20° C. for several weeks.

2. Enzymatic Digestion

A panel of enzymes was tested to determine cleavage efficiency of each enzyme for AC1611. 6 µM of the substrate was incubated with each enzyme in the following enzyme-to-substrate molar ratios and conditions: uPA (1:25 in 50 mM Tris pH 8.5), matriptase (1:25 in 50 mM Tris pH 9, 50 mM NaCl), legumain (1:20 in 50 mM MES pH 5, 250 mM NaCl), MMP-2 (1:1200 in 50 mM Tris pH 7.5, 150 mM NaCl, 10 mM $CaCl_2$)), MMP-7 (1:1200 in 50 mM Tris pH 7.5, 150 mM NaCl, 10 mM $CaCl_2$)), MMP-9 (1:2000 in 50 mM Tris pH 7.5, 150 mM NaCl, 10 mM CaCl2)), and MMP-14 (1:30 in 50 mM Tris pH 8.5, 3 mM $CaCl_2$), 1 µM ZnCl2) in 20 uL reactions. Reactions were incubated at 37° C. for two hours before stopped by adding EDTA to 20 mM in the case of MMP reactions, heating at 85° C. for 15 minutes in the case of uPA and matriptase reactions, and adjusting pH to 8.5 in the case of legumain.

3. Analysis of Cleavage Efficiency.

Figure 75:
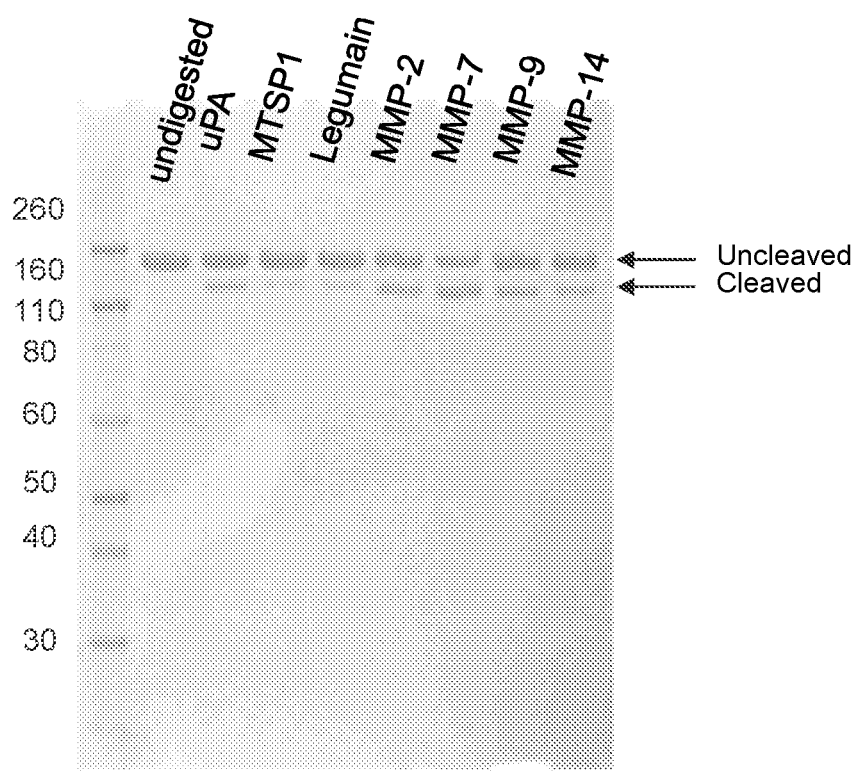
FIG. 75 shows an SDS-PAGE gel of the cleavage profile of AC1611 when subject to seven human proteases implicated in cancer, as described in Example 42.

Analysis of the samples to determine percentage of cleaved product was performed by loading 2 µL of undigested substrate (at 12 µM) and 4 µL digested (at 6 µM) reaction mixture on SDS-PAGE and staining with Stains-All (Sigma Aldrich), as shown on FIG. 75. ImageJ software was used to analyze corresponding band intensity and determine percent of cleavage. Upon cleavage by various proteases at the Release Segment, the substrate RSR-1517-containing XTEN would yield two fragments, and the larger fragment was utilized in % cleavage calculations (quantity of reaction product divided by total initial substrate went into the reaction) while band intensity of the smaller product is too low to quantify. The percentage of cleavage of AC1611 under the current standard experimental conditions is 31%, 14%, 16%, 40%, 51%, 38%, 30%, for uPA, matriptase, legumain, MMP-2, MMP-7, MMP-9, MMP-14, respectively.

Conclusions: We selected a particular Release Segment RSR-1517 (amino acid sequence EAGRSANHEPLGLVAT (SEQ ID NO.: 1)) and determined its cleavage profile as defined by percentage of cleavage under current standard experimental condition for all seven enzymes. This Release Segment has intermediate cleavage efficiency for all enzymes so that during screening, cleavage of faster or slower variants will fall within the assay window to allow accurate ranking.

Example 43: Screening Release Segment Using RSR-1517 (AC1611) as Control

Here we select uPA as the example to show how the Release Segment screening was performed. The same procedure was applied to all seven tumor-associated proteases to define the relative cleavage profile for each substrate, which is a seven number array to describe how well it can be cleaved for each enzyme, when compared to the control substrate RSR-1517.

1. Enzymatic Digestion

Figure 76:
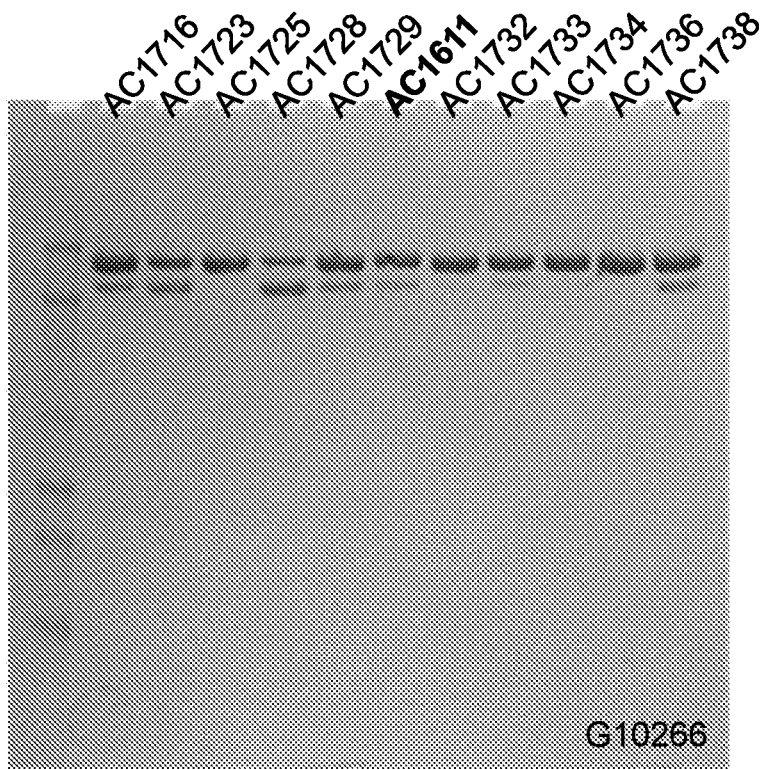
FIG. 76 shows an SDS-PAGE gel of the uPA digestion of RS-XTEN variants with AC1611 as the reference, as described in Example 43.

All Release Segment-containing XTEN variants and the control AC1611 were diluted to 12 µM in 50 mM Tris pH 7.5, 150 mM NaCl, 10 mM CaCl2) in individual Eppendorf tubes. A master mix of uPA was prepared so that after 1:1 mixing with each substrate, the total reaction volume is 20 µL, the initial substrate concentration is 6 µM, and the enzyme-to-substrate ratio was varied between 1:20 to 1:3000, depending on the enzyme, in order to have reaction products and uncleaved substrate that could be visualized at the endpoint. All reactions were incubated at 37° C. for 2 hours before stopped by adding EDTA to a final concentration of 20 mM. All products were analyzed by non-reducing SDS-PAGE followed by Stains-All. For each gel, AC1611 digestion product was always included as the staining control to normalize differential staining between different gels (FIG. 76).

2. Relative Cleavage Efficiency Calculation

Percentage of cleavage for individual substrate was analyzed by ImageJ software and calculated as described before. For each variant, the relative cleavage efficiency is calculated as follows:

$$\text{Log}_2\left(\frac{\text{\% Cleaved for substrate of interest}}{\text{\% cleaved for } AC1611 \text{ in the same experiment}}\right)$$

A +1 value in relative cleavage efficiency indicates the substrate yielded twice as much product when compared to the AC1611 control while a −1 value in relative cleavage efficiency indicates the substrate yielded only 50% as much product when compared to the AC1611 control, under the experimental condition specified above.

In this experiment, the percentage of cleavage (% cleaved) for AC1611 is 20%, as quantified by ImageJ. The substrates being screened in this experiment demonstrated 21%, 39%, 1%, 58%, 24%, 6%, 15%, 1%, 1%, and 25% cleavage, where 1% essentially represents below detection limit and does not indicate accurate values. The relative cleavage efficiencies calculated based on the formula above were 0.08, 0.95, −4.34, 1.51, 0.26, −1.76, −0.47, −4.34, −4.34, and 0.32, respectively.

Conclusions: We determined relative cleavage efficiencies of 10 Release Segment variants when subject to uPA when compared to AC1611 in the same experiment. Following similar procedures, we determined the cleavage profiles of 134 Release Segments, the results of which are listed in Table 17, using RSR1517 (AC1611) as the reference control. These Release Segments covers a wide range of cleavage efficiency for individual enzyme as well as combinations. For example, RSR-1478 has a −2.00 value for MMP-14, meaning that this substrate yielded only 25% of product compared to the reference control RSR-1517 when digested with MMP-14. Certain Release Segments, such as RSR-1951, appear to be better substrate for all seven proteases tested. These faster Release Segments may prove to be useful in the clinic if the systemic toxicity is low/manageable while efficacy (partially depending on how fast cleavage happens to render ProTIA as the activated form) needs improvement.

TABLE 17

Cleavage profiles of Release Segment when subjected to seven human proteases using RSR-1517 as control

| RSID | AC# | AA Sequence | SEQ ID NO.: | uPA | Matriptase | Legumain | MMP-2 | MMP-7 | MMP-9 | MMP-14 |
|---|---|---|---|---|---|---|---|---|---|---|
| RSR-1517 | AC1611 | EAGRSANHEPLGLVAT | 1 | 0.00 | 0.00 | 0.00 | 0.00 | 0.00 | 0.00 | 0.00 |
| BSRS-4 | AC1602 | LAGRSDNHSPLGLAGS | 1004 | −0.99 | 1.69 | 0.48 | 0.09 | −0.49 | −0.04 | −0.58 |
| BSRS-5 | AC1603 | LAGRSDNHVPLSLSMG | 1005 | −1.40 | 1.76 | 0.56 | −0.52 | 0.00 | −0.75 | −0.21 |
| BSRS-6 | AC1604 | LAGRSDNHEPLELVAG | 1006 | −2.71 | 0.47 | 0.23 | −1.26 | 0.00 | −1.16 | −2.79 |
| BSRS-A1 | AC1605 | ASGRSTNAGPSGLAGP | 2 | 1.43 | 2.77 | 0.09 | −0.16 | −2.18 | 0.03 | −1.24 |
| BSRS-A2 | AC1606 | ASGRSTNAGPQGLAGQ | 3 | 1.36 | 2.77 | −0.14 | 0.09 | −2.64 | 0.03 | −1.03 |
| BSRS-A3 | AC1607 | ASGRSTNAGPPGLTGP | 4 | 1.49 | 2.77 | 0.05 | −1.07 | −3.47 | −1.82 | −3.59 |
| VP-1 | AC1608 | ASSRGTNAGPAGLTGP | 5 | −2.19 | 1.16 | 0.90 | 0.09 | −1.22 | 0.23 | 0.00 |
| RSR-1752 | AC1609 | ASSRTTNTGPSTLTGP | 6 | −0.55 | 0.70 | 0.29 | −0.34 | −1.29 | −0.94 | −5.38 |
| RSR-1512 | AC1610 | AAGRSDNGTPLELVAP | 7 | −2.96 | 1.51 | 0.56 | −1.43 | −0.45 | −1.09 | −3.91 |
| RSR-1517 | AC1611 | EAGRSANHEPLGLVAT | 1 | 0.00 | 0.00 | 0.00 | 0.00 | 0.00 | 0.00 | 0.00 |
| VP-2 | AC1612 | ASGRGTNAGPAGLTGP | 8 | −0.70 | 1.38 | 1.12 | 0.00 | −0.58 | 0.23 | −0.15 |
| RSR-1018 | AC1613 | LFGRNDNHEPLELGGG | 9 | −4.62 | −0.53 | 1.36 | −0.73 | −0.43 | −2.56 | −1.79 |
| RSR-1053 | AC1614 | TAGRSDNLEPLGLVFG | 10 | −3.21 | −0.12 | −0.13 | 0.09 | −0.03 | 0.25 | −0.19 |
| RSR-1059 | AC1615 | LDGRSDNFHPPELVAG | 11 | −4.62 | −0.89 | 0.56 | −3.10 | −2.62 | −5.14 | −6.49 |
| RSR-1065 | AC1616 | LEGRSDNEEPENLVAG | 12 | −4.62 | −2.70 | 0.43 | −1.84 | −1.00 | −3.14 | −1.85 |
| RSR-1167 | AC1617 | LKGRSDNNAPLALVAG | 13 | −4.62 | 3.35 | 1.32 | 0.09 | 0.22 | 1.18 | 0.06 |
| RSR-1201 | AC1618 | VYSRGTNAGPHGLTGR | 14 | −3.02 | 2.35 | 1.25 | 0.09 | −1.30 | 0.79 | −0.30 |
| RSR-1218 | AC1619 | ANSRGTNKGFAGLIGP | 15 | −0.52 | 2.66 | 1.74 | −0.30 | 0.00 | −1.33 | −1.60 |
| RSR-1226 | AC1620 | ASSRLTNEAPAGLTIP | 16 | −0.98 | 0.29 | 0.58 | 0.07 | −0.43 | −2.33 | −0.42 |
| RSR-1254 | AC1621 | DQSRGTNAGPEGLTDP | 17 | −1.27 | −1.17 | 1.00 | −3.10 | −2.32 | −4.14 | −2.92 |
| RSR-1256 | AC1622 | ESSRGTNIGQGGLTGP | 18 | −1.65 | −0.58 | 0.27 | −2.26 | −3.32 | −5.14 | −5.51 |
| RSR-1261 | AC1623 | SSSRGTNQDPAGLTIP | 19 | −1.77 | −0.36 | 0.62 | −1.14 | −1.25 | −3.56 | −0.98 |

TABLE 17-continued

Cleavage profiles of Release Segment when subjected to seven human proteases using RSR-1517 as control

| RSID | AC# | AA Sequence | SEQ ID NO.: | uPA | Matriptase | Legumain | MMP-2 | MMP-7 | MMP-9 | MMP-14 |
|---|---|---|---|---|---|---|---|---|---|---|
| RSR-1293 | AC1624 | ASSRGQNHSPMGLTGP | 20 | -4.69 | 2.15 | 0.91 | -0.70 | -0.01 | 1.30 | -0.67 |
| RSR-1309 | AC1625 | AYSRGPNAGPAGLEGR | 21 | -4.69 | 0.53 | 0.74 | -0.70 | -2.25 | 0.86 | 0.02 |
| RSR-1326 | AC1626 | ASERGNNAGPANLTGF | 22 | -0.27 | 1.27 | 1.64 | -0.85 | -0.74 | 0.28 | -0.13 |
| RSR-1345 | AC1627 | ASHRGTNPKPAILTGP | 23 | 0.42 | ND | ND | ND | ND | -0.50 | ND |
| RSR-1354 | AC1628 | MSSRRTNANPAQLTGP | 24 | 1.07 | 2.82 | 0.36 | -0.77 | -0.64 | -1.82 | -1.87 |
| RSR-1426 | AC1629 | GAGRTDNHEPLELGAA | 25 | -2.36 | -0.65 | -0.19 | -2.82 | -0.18 | -0.11 | -4.07 |
| RSR-1478 | AC1630 | LAGRSENTAPLELTAG | 26 | -2.06 | 1.18 | 0.54 | -0.82 | 0.00 | 1.73 | -2.00 |
| RSR-1479 | AC1631 | LEGRPDNHEPLALVAS | 27 | -3.47 | -3.46 | 0.12 | -0.74 | 0.00 | 2.05 | 0.02 |
| RSR-1496 | AC1632 | LSGRSDNEEPLALPAG | 28 | -3.48 | -1.46 | 0.22 | -2.81 | -5.06 | -3.20 | -3.22 |
| RSR-1508 | AC1633 | EAGRTDNHEPLELSAP | 29 | -2.74 | -1.46 | -0.26 | -1.48 | 0.00 | 0.56 | -2.93 |
| RSR-1513 | AC1634 | EGGRSDNHGPLELVSG | 30 | -2.81 | -1.87 | 0.27 | -0.90 | 0.00 | 1.29 | -3.81 |
| RSR-1516 | AC1635 | LSGRSDNEAPLELEAG | 31 | -3.71 | -1.87 | 0.70 | -1.69 | -0.09 | -1.39 | -3.22 |
| RSR-1524 | AC1636 | LGGRADNHEPPELGAG | 32 | -0.84 | 1.12 | 0.95 | -1.22 | -2.84 | -0.74 | -2.57 |
| RSR-1622 | AC1637 | PPSRGTNAEPAGLTGE | 33 | -4.66 | -3.46 | 0.62 | -0.70 | -1.09 | 0.93 | -0.78 |
| RSR-1629 | AC1638 | ASTRGENAGPAGLEAP | 34 | -4.66 | -1.14 | 1.09 | -0.70 | -1.74 | 0.19 | -0.25 |
| RSR-1664 | AC1639 | ESSRGTNGAPEGLTGP | 35 | -4.66 | -3.46 | 0.32 | -1.18 | -0.76 | -0.76 | -2.31 |
| RSR-1667 | AC1640 | ASSRATNESPAGLTGE | 36 | -3.05 | 2.00 | 0.46 | -0.93 | -1.25 | -0.97 | -0.83 |
| RSR-1709 | AC1641 | ASSRGENPPPGGLTGP | 37 | -2.64 | 0.77 | -1.00 | -0.93 | -2.06 | -0.76 | -1.72 |
| RSR-1712 | AC1642 | AASRGTNTGPAELTGS | 38 | -4.07 | -0.51 | 0.66 | -0.93 | -0.64 | 0.29 | -0.19 |
| RSR-1727 | AC1643 | AGSRTTNAGPGGLEGP | 39 | -3.55 | -0.51 | 0.32 | -1.58 | -4.84 | -3.08 | -1.78 |
| RSR-1754 | AC1644 | APSRGENAGPATLTGA | 40 | -4.68 | -3.32 | 1.06 | 0.19 | -1.40 | -1.50 | -0.17 |
| RSR-1819 | AC1645 | ESGRAANTGPPTLTAP | 41 | 1.20 | 0.79 | -0.70 | -3.41 | -5.64 | -4.67 | -6.92 |
| RSR-1832 | AC1646 | NPGRAANEGPPGLPGS | 42 | -3.62 | 0.58 | 0.81 | -4.39 | -6.64 | -4.67 | -6.48 |
| RSR-1855 | AC1647 | ESSRAANLTPPELTGP | 43 | -0.08 | -1.62 | 0.77 | -3.07 | -3.47 | -4.67 | -2.92 |
| RSR-1911 | AC1648 | ASGRAANETPPGLTGA | 44 | 0.99 | 2.20 | 0.56 | -1.29 | -3.84 | -1.39 | -3.11 |
| RSR-1929 | AC1649 | NSGRGENLGAPGLTGT | 45 | -1.68 | ND | ND | ND | ND | -3.08 | ND |
| RSR-1951 | AC1650 | TTGRAANLTPAGLTGP | 46 | 1.94 | 2.57 | 0.39 | 0.09 | -0.09 | 0.13 | -0.42 |
| RSR-2295 | AC1761 | EAGRSANHTPAGLTGP | 47 | 0.40 | 1.48 | 0.01 | 1.20 | 0.35 | 0.13 | 0.97 |
| RSR-2298 | AC1762 | ESGRAANTTPAGLTGP | 48 | 1.01 | 0.86 | 0.55 | 1.24 | 0.24 | 0.07 | 1.03 |
| RSR-2038 | AC1679 | TTGRATEAANLTPAGLTGP | 49 | 4.75 | 1.00 | 0.81 | 0.86 | 0.10 | 0.15 | 0.27 |
| RSR-2072 | AC1680 | TTGRAEEAANLTPAGLTGP | 50 | 0.00 | -0.49 | 1.00 | 0.86 | 0.11 | -0.12 | 0.27 |
| RSR-2089 | AC1681 | TTGRAGEAANLTPAGLTGP | 51 | 3.91 | 2.05 | 0.32 | 0.85 | 0.02 | -0.04 | 0.27 |
| RSR-2302 | AC1682 | TTGRATEAANATPAGLTGP | 52 | 4.73 | 0.65 | 0.00 | 0.74 | -0.48 | -0.35 | 0.10 |
| RSR-3047 | AC1697 | TTGRAGEAEGATSAGATGP | 53 | | | | | | | |
| RSR-3052 | AC1698 | TTGEAGEAANATSAGATGP | 54 | | | | | | | |
| RSR-3043 | AC1699 | TTGEAGEAAGLTPAGLTGP | 55 | | | | | | | |
| RSR-3041 | AC1700 | TTGAAGEAANATPAGLTGP | 56 | | | | | | | |

TABLE 17-continued

Cleavage profiles of Release Segment when subjected to seven human proteases using RSR-1517 as control

| RSID | AC# | AA Sequence | SEQ ID NO.: | uPA | Matriptase | Legumain | MMP-2 | MMP-7 | MMP-9 | MMP-14 |
|---|---|---|---|---|---|---|---|---|---|---|
| RSR-3044 | AC1701 | TTGRAGEAAGLTPAGLTGP | 57 | | | | | | | |
| RSR-3057 | AC1702 | TTGRAGEAANATSAGATGP | 58 | | | | | | | |
| RSR-3058 | AC1703 | TTGEAGEAAGATSAGATGP | 59 | | | | | | | |
| RSR-2485 | AC1763 | ESGRAANTEPPELGAG | 60 | 0.61 | -0.90 | 0.15 | -5.82 | -6.27 | -5.36 | -5.64 |
| RSR-2486 | AC1764 | ESGRAANTAPEGLTGP | 61 | 1.03 | 0.24 | 0.95 | 0.30 | 0.37 | -0.33 | -0.74 |
| RSR-2488 | AC1688 | EPGRAANHEPSGLTEG | 62 | -3.27 | -1.21 | -1.30 | -0.73 | -0.91 | -1.86 | -0.88 |
| RSR-2599 | AC1706 | ESGRAANHTGAPPGGLTGP | 63 | 1.70 | 1.02 | 0.36 | 0.68 | -1.49 | -0.71 | -2.04 |
| RSR-2706 | AC1716 | TTGRTGEGANATPGGLTGP | 64 | 0.07 | 0.83 | 1.17 | -0.04 | -2.25 | -2.25 | 0.00 |
| RSR-2707 | AC1717 | RTGRSGEAANETPEGLEGP | 65 | 1.95 | 3.25 | 0.96 | -1.96 | -2.75 | -5.00 | -1.39 |
| RSR-2708 | AC1718 | RTGRTGESANETPAGLGGP | 66 | 1.24 | 3.25 | 0.88 | -0.37 | -3.55 | -4.00 | -0.49 |
| RSR-2709 | AC1719 | STGRTGEPANETPAGLSGP | 67 | -0.14 | 0.38 | 0.40 | 0.35 | -1.03 | -1.68 | 1.86 |
| RSR-2710 | AC1720 | TTGRAGEPANATPTGLSGP | 68 | -0.21 | 2.04 | 0.56 | 0.15 | -3.23 | -1.83 | -0.07 |
| RSR-2711 | AC1721 | RTGRPGEGANATPTGLPGP | 69 | 0.58 | 3.22 | 1.45 | -6.04 | -5.55 | -5.00 | -4.39 |
| RSR-2712 | AC1722 | RTGRGGEAANATPSGLGGP | 70 | 0.86 | 3.15 | 1.21 | -0.34 | -3.97 | -2.68 | -1.58 |
| RSR-2713 | AC1723 | STGRSGESANATPGGLGGP | 71 | 0.96 | 2.22 | 0.78 | -5.04 | -5.25 | -5.25 | -3.32 |
| RSR-2714 | AC1724 | RTGRTGEEANATPAGLPGP | 72 | 0.83 | 3.23 | 0.96 | -4.46 | -5.55 | -5.00 | -4.39 |
| RSR-2715 | AC1725 | ATGRPGEPANTTPEGLEGP | 73 | -4.32 | -3.17 | 0.46 | -1.34 | -1.93 | -1.93 | -1.32 |
| RSR-2716 | AC1726 | STGRSGEPANATPGGLTGP | 74 | 1.00 | 2.41 | 0.51 | -0.46 | -3.55 | -2.68 | -1.22 |
| RSR-2717 | AC1727 | PTGRGGEGANTTPTGLPGP | 75 | -0.21 | 1.54 | 1.28 | -6.04 | -5.55 | -5.00 | -4.39 |
| RSR-2718 | AC1728 | PTGRSGEGANATPSGLTGP | 76 | 1.54 | 3.40 | 1.29 | 1.30 | -0.20 | -0.20 | 1.63 |
| RSR-2719 | AC1729 | TTGRASEGANSTPAPLTEP | 77 | 0.26 | 1.15 | 1.30 | -1.46 | -0.16 | -0.16 | 1.68 |
| RSR-2720 | AC1730 | TYGRAAEAANTTPAGLTAP | 78 | -1.65 | 2.14 | 1.21 | 0.56 | 0.45 | 0.21 | 2.25 |
| RSR-2721 | AC1731 | TTGRATEGANATPAELTEP | 79 | 0.77 | -0.85 | 1.25 | -2.44 | 0.00 | -4.91 | -3.75 |
| RSR-2722 | AC1732 | TVGRASEEANTTPASLTGP | 80 | -1.74 | -1.17 | 0.39 | 1.08 | 1.00 | 1.00 | 2.14 |
| RSR-2723 | AC1733 | TTGRAPEAANATPAPLTGP | 81 | -0.42 | -3.17 | 1.32 | 0.76 | 0.66 | 0.66 | 2.17 |
| RSR-2724 | AC1734 | TWGRATEPANATPAPLTSP | 82 | -4.32 | 1.00 | 0.55 | 0.81 | 0.42 | 0.42 | 2.58 |
| RSR-2725 | AC1735 | TVGRASESANATPAELTSP | 83 | -4.32 | -0.17 | 0.86 | -0.02 | 0.45 | -1.74 | -2.17 |
| RSR-2726 | AC1736 | TVGRAPEGANSTPAGLTGP | 84 | -4.32 | -3.17 | 1.39 | 1.22 | 0.24 | 0.24 | 2.10 |
| RSR-2727 | AC1737 | TWGRATEAPNLEPATLTTP | 85 | -4.32 | 0.00 | -0.30 | -0.50 | 0.17 | -3.91 | -1.95 |
| RSR-2728 | AC1738 | TTGRATEAPNLTPAPLTEP | 86 | 0.32 | 0.83 | -0.61 | -0.80 | 0.45 | 0.45 | 2.00 |
| RSR-2729 | AC1739 | TQGRATEAPNLSPAALTSP | 87 | -4.52 | 1.73 | 0.37 | 1.75 | 0.93 | 0.93 | 2.85 |
| RSR-2730 | AC1740 | TQGRAAEAPNLTPATLTAP | 88 | -2.20 | 2.73 | 0.22 | 1.19 | 0.51 | 0.51 | 1.29 |
| RSR-2731 | AC1741 | TSGRAPEATNLAPAPLTGP | 89 | -1.72 | -2.70 | 1.22 | 1.57 | 0.92 | 0.92 | 2.32 |
| RSR-2732 | AC1742 | TQGRAAEAANLTPAGLTEP | 90 | -2.52 | 2.49 | 1.44 | 0.32 | -0.21 | -0.21 | 2.29 |
| RSR-2733 | AC1743 | TTGRAGSAPNLPPTGLTTP | 91 | 1.09 | 2.91 | 0.32 | 0.48 | -2.32 | -2.32 | -3.17 |
| RSR-2734 | AC1744 | TTGRAGGAENLPPEGLTAP | 92 | 0.83 | 2.00 | 0.66 | 0.55 | 0.55 | 0.55 | 1.83 |
| RSR-2735 | AC1745 | TTSRAGTATNLTPEGLTAP | 93 | 0.38 | 2.34 | 0.32 | 0.48 | 0.26 | 0.26 | 2.12 |

TABLE 17-continued

Cleavage profiles of Release Segment when subjected to seven human proteases using RSR-1517 as control

| RSID | AC# | AA Sequence | SEQ ID NO.: | uPA | Matriptase | Legumain | MMP-2 | MMP-7 | MMP-9 | MMP-14 |
|---|---|---|---|---|---|---|---|---|---|---|
| RSR-2736 | AC1746 | TTGRAGTATNLPPSGLTTP | 94 | 1.03 | 2.91 | 0.17 | 1.34 | -1.10 | -1.10 | 1.42 |
| RSR-2737 | AC1747 | TTARAGEAENLSPSGLTAP | 95 | -0.20 | 0.30 | 0.37 | 1.57 | -0.03 | -0.03 | 2.35 |
| RSR-2738 | AC1748 | TTGRAGGAGNLAPGGLTEP | 96 | 1.68 | 3.37 | 1.03 | -1.32 | -1.65 | -2.10 | -1.05 |
| RSR-2739 | AC1749 | TTGRAGTATNLPPEGLTGP | 97 | 1.49 | 3.43 | 0.31 | -0.12 | 0.71 | -0.58 | -0.67 |
| RSR-2740 | AC1750 | TTGRAGGAANLAPTGLTEP | 98 | 1.77 | 3.38 | 1.49 | -1.02 | -0.75 | -1.32 | -0.43 |
| RSR-2741 | AC1751 | TTGRAGTAENLAPSGLTTP | 99 | 0.68 | 3.10 | 0.56 | 0.58 | -0.51 | -0.91 | 0.42 |
| RSR-2742 | AC1752 | TTGRAGSATNLGPGGLTGP | 100 | 1.43 | 3.42 | 0.51 | -0.27 | -3.23 | -2.32 | -0.17 |
| RSR-2743 | AC1753 | TTARAGGAENLTPAGLTEP | 101 | 1.63 | 2.19 | 0.78 | -0.50 | -0.13 | -2.58 | 1.18 |
| RSR-2744 | AC1754 | TTARAGSAENLSPSGLTGP | 102 | 1.04 | 2.32 | 0.65 | 0.59 | 0.00 | -0.15 | 0.49 |
| RSR-2745 | AC1755 | TTARAGGAGNLAPEGLTTP | 103 | 1.12 | 2.77 | 0.40 | -0.77 | -0.58 | -2.28 | -1.00 |
| RSR-2746 | AC1756 | TTSRAGAAENLTPTGLTGP | 104 | -0.81 | 1.54 | 0.18 | 0.42 | -0.85 | -1.50 | -0.26 |
| RSR-2747 | AC1757 | TYGRTTTPGNEPPASLEAE | 105 | -1.49 | 1.26 | 0.06 | -0.20 | -0.36 | -2.77 | -2.10 |
| RSR-2748 | AC1758 | TYSRGESGPNEPPPGLTGP | 106 | -4.81 | -2.32 | -0.76 | -0.28 | -2.68 | -2.28 | -2.91 |
| RSR-2749 | AC1759 | AWGRTGASENETPAPLGGE | 107 | -4.81 | 3.15 | 0.24 | -1.28 | -3.91 | -5.09 | -2.58 |
| RSR-2750 | AC1760 | RWGRAETTPNTPPEGLETE | 108 | -1.49 | 3.28 | -0.29 | -3.17 | -3.91 | -5.09 | -4.91 |
| RSR-2751 | AC1765 | ESGRAANHTGAEPPELGAG | 109 | 1.04 | 0.37 | 0.40 | -1.59 | -5.67 | -5.26 | -4.93 |
| RSR-2754 | AC1801 | TTGRAGEAANLTPAGLTES | 110 | | | | -0.15 | -0.82 | -3.61 | 0.45 |
| RSR-2755 | AC1802 | TTGRAGEAANLTPAALTES | 111 | | | | 0.06 | 0.29 | -2.91 | 0.62 |
| RSR-2756 | AC1803 | TTGRAGEAANLTPAPLTES | 112 | | | | -0.58 | -0.39 | -2.58 | 0.49 |
| RSR-2757 | AC1804 | TTGRAGEAANLTPEPLTES | 113 | | | | -1.59 | -0.27 | -1.89 | -0.52 |
| RSR-2758 | AC1805 | TTGRAGEAANLTPAGLTGA | 114 | | | | 0.70 | -0.43 | 0.17 | 0.85 |
| RSR-2759 | AC1806 | TTGRAGEAANLTPEGLTGA | 115 | | | | 0.04 | -0.72 | -1.06 | -0.18 |
| RSR-2760 | AC1807 | TTGRAGEAANLTPEPLTGA | 116 | | | | -0.06 | -0.12 | -1.90 | -0.15 |
| RSR-2761 | AC1808 | TTGRAGEAANLTPAGLTEA | 117 | | | | -0.06 | -0.55 | -3.71 | 0.69 |
| RSR-2762 | AC1809 | TTGRAGEAANLTPEGLTEA | 118 | | | | -2.14 | -0.69 | -4.30 | -0.59 |
| RSR-2763 | AC1810 | TTGRAGEAANLTPAPLTEA | 119 | | | | -0.76 | -0.31 | -5.28 | 0.64 |
| RSR-2764 | AC1811 | TTGRAGEAANLTPEPLTEA | 120 | | | | -2.18 | -0.06 | -5.28 | -0.11 |
| RSR-2765 | AC1812 | TTGRAGEAANLTPEPLTGP | 121 | | | | -0.31 | 0.07 | -5.28 | -5.63 |
| RSR-2766 | AC1813 | TTGRAGEAANLTPAGLTGG | 122 | | | | 0.77 | -0.61 | -5.28 | -5.63 |
| RSR-2767 | AC1814 | TTGRAGEAANLTPEGLTGG | 123 | | | | -0.20 | -0.85 | -1.26 | -0.25 |
| RSR-2768 | AC1815 | TTGRAGEAANLTPEALTGG | 124 | | | | -0.50 | 0.13 | -1.80 | -0.43 |
| RSR-2769 | AC1816 | TTGRAGEAANLTPEPLTGG | 125 | | | | -0.44 | -0.26 | -2.40 | -0.39 |
| RSR-2770 | AC1817 | TTGRAGEAANLTPAGLTEG | 126 | | | | -0.07 | -0.47 | -3.18 | 0.40 |
| RSR-2771 | AC1818 | TTGRAGEAANLTPEGLTEG | 127 | | | | -3.05 | -0.93 | -5.28 | -0.99 |

TABLE 17-continued

Cleavage profiles of Release Segment when subjected to seven human proteases using RSR-1517 as control

| RSID | AC# | AA Sequence | SEQ ID NO.: | uPA | Matriptase | Legumain | MMP-2 | MMP-7 | MMP-9 | MMP-14 |
|---|---|---|---|---|---|---|---|---|---|---|
| RSR-2772 | AC1819 | TTGRAGEAANLTPAPLTEG | 128 | | | | -0.53 | -0.24 | -2.19 | 0.39 |
| RSR-2773 | AC1820 | TTGRAGEAANLTPEPLTEG | 129 | | | | -3.80 | -0.42 | -5.28 | -0.81 |
| BSRS-1 | AC1601 | LSGRSDNHSPLGLAGS | 927 | 0.89 | 1.94 | 0.10 | -0.67 | -2.12 | -0.50 | -1.92 |

ND = not determined

Example 44: Competitive Digestion Using RSR-1517 as Internal Control

This competitive assay is developed to minimize any variability in enzyme concentration or reaction condition between reactions in different vials within the same experiment. In order to resolve both the control substrate and the RS of interest in the same example, new control plasmids are constructed.

1. Molecular Cloning of RSR-1517-Containing Internal Control

Two internal control plasmids, AC1830 (HD2-V5-AE144-RSR-1517-XTEN288) and AC1840 (HD2-V5-AE144-RSR-1517-XTEN432), are constructed in a similar fashion as AC1611 described in Example 39, with the only difference in the length of the C-terminal XTEN.

2. Enzymatic Digestion

2× substrate solution is prepared by mixing and diluting purified AC1830 or AC1840 and the RS of interest in assay buffer so that the final concentrations of individual substrates are 6 µM. An enzyme master mix is prepared so that after 1:1 mixing with 2× substrate solution, the total reaction volume is 20 µL, the final substrate concentration of each component is 3 µM, and the enzyme-to-substrate ratio is as selected in assay development. The reaction is incubated at 37° C. for 2 hours before stopped by procedures as described above.

3. Relative Cleavage Efficiency Calculation

The reaction mixture is analyzed by non-reducing 4-12% SDS-PAGE. Since the internal control and the substrate of interest have different molecular weight, once cleaved, four bands should be visible in the same sample lane. Percentage of cleavage for both can be calculated and the relative cleavage efficiency can be derived from the same formula in Example 43:

$$\mathrm{Log}_2\left(\frac{\%\ \text{Cleaved for substrate of interest}}{\%\ \text{cleaved for } AC1611 \text{ in the same experiment}}\right)$$

The only difference is now both values are calculated from the reaction mixture in the same vial, while previously from two reactions sharing the same enzyme mix.

Conclusions: We expect this competitive digestion assay with RSR-1517 as internal control to have less assay-to-assay variability when compared to the assay described in Example 43. We anticipate to adopt this method for future Release Segment screening.

Example 45: Construction of ProTIA Molecules with Two Release Sites

In order to generate a ProTIA with both an N-terminal and C-terminal XTEN, the XTEN292 was PCR amplified from a plasmid using primers including a 17-21 bp 5' homology region to backbone DNA on the N-terminus and to an uncleavable release site (RSR3028, amino acid sequence TTGEAGEAAGATSAGATGP (SEQ ID NO.: 59)) on the C-terminus. A second set of PCR products encoding the light and part of the heavy chain of the anti-EpCAM antibody 4D5MOCB was amplified using primers that included a 16-21 bp 5' homology region to RSR3058 on the N-terminus and the heavy chain of 4D5MOCB on the C-terminus. These PCR fragments were cloned into a backbone vector digested with BsiWI-SacII that encoding the remainder of the 4D5MOCB heavy chain/anti-CD3 tandem scFv, a second copy of the RSR3058 uncleavable release site and XTEN867 with a 6×HIS affinity tag using the In-Fusion Plasmid Assembly Kit (Takara Bio). The final vector encodes the ProTIA molecule with the components (in the N- to C-terminus) of XTEN292, the uncleavable RSR3058, anti-EpCAM-anti-CD3 bispecific tandem scFv with RSR3058 fused to XTEN_867 with a 6×HIS affinity tag under the control of a PhoA promoter and STII secretion leader. The resulting construct is AC1886 with the DNA sequence and encoded amino acid sequence provided in Table 18.

AC1886 was used as a template to create two ProTIA construct encoding XTEN292, the cleavable release segment RSR2295, anti-EpCAM-anti-CD3 bispecific tandem scFv with RSR2295 fused to XTEN_868. Both plasmids utilized two common PCR products using AC1886 as a template; the first encoding a 6×HIS affinity tag and XTEN292 with an 5' homology region to the vector backbone and the 3' homology region encoding the first RSR2295, the second encoding the anti-EpCAM-anti-CD3 bispecific tandem scFv with 5' and 3' homology regions encoding the RSR2295 segments 5' and 3' of the tandem scFvs. The third fragment different between the two constructs. The third fragment for AC1955 encoded XTEN868 and the C-Tag affinity tag (amino acid sequence EPEA) with a 5' homology region encoding the second RSR2295 and a 3' homology region to the backbone vector. The third fragment for AC1954 encoded XTEN866 and a 6×HIS affinity tag with a 5' homology region encoding the second RSR2295 and a 3' homology region to the backbone vector. For both AC1955 and AC1954, the three PCR fragments were cloned into AC1886 that had been digested with BsiWI-NotI using the In-Fusion Plasmid Assembly Kit. The final vector AC1955 encodes the ProTIA molecule with the components (in the N- to C-terminus) of 6×HIS affinity tag, XTEN292, RSR2295, anti-EpCAM-anti-CD3 bispecific tandem scFv, RSR2295, XTEN868 and a C-Tag affinity tag under the control of a PhoA promoter and STII secretion leader with the DNA sequence and encoded amino acid sequence provided in Table 18. The final vector AC1954 encodes the ProTIA molecule with the components (in the N- to C-terminus) of 6×HIS affinity tag, XTEN292, RSR2295, anti-EpCAM-anti-CD3 bispecific tandem scFv, RSR2295, XTEN866 and a 6×HIS affinity tag under the control of a PhoA promoter and STII secretion leader with the DNA sequence and encoded amino acid sequence provided in Table 11. ProTIA constructs with different release segments or tumor-specific scFvs were cloned by digesting AC1954 or AC1955 with DraIII-BtsI, followed by In-Fusion mediated cloning of PCR products containing the structure release site-tumor scFv-anti-CD3 scFv-release site with 17-20 bp 5' homology regions to the XTEN292 and 3' homology regions to the C-terminal XTEN. AC1954 was used as a backbone for making the contructs AC1948, AC1952 and AC1969. AC1955 was used as a backbone for making constructs AC1972, AC1976, AC2009, AC2078, AC2084 and the sequences of these constructs are provided in Table 12.

TABLE 18

DNA and amino acid sequence of ProTIA constructs of Example 45

| Construct Name | DNA Sequence | Amino Acid Sequence* |
|---|---|---|
| AC1886 | TTCTCATGTTTGACAGCTTATCATCGATAAGCTTTAATGCGGTAGTTTATCACA GTTAAATTGCTAACGCAGTCAGGCACCGTGTATGAAATCTAACAATGCGCTCAT CGTCATCCTCGGCACCGTCACCCTGGATGCTGTAGGCATAGGCTTGGTTATGCC GGTACTGCCGGGCCTCTTTGCGGGATATCGTCCATTCCGACAGCATCGCCAGTCA CTATGGCGTGCTGCTCGCGCTATATGCGTTGATGCAATTTCTATGCGCACCCGT TCTCGGAGCACTGTCCGACCGCTTTGGCCGCCGCCCAGTCCTGCTCGCTTCGCT ACTTGGAGCCACTATCGACTACGCGATCATGGCGACCACACCCGTCCTGTGGAT CCTCTACGCCGGACGCATCGTGGCCGGCATCACCGGCGCCACAGGTGCGGTTGC TGGCGCCTATATCGCCGACATCACCGATGGGGAAGATCGGGCTCGCCACTTCGG GCTCATGAGCGCTTGTTTCGGCGTGGGTATGGTGGCAGGCCCCGTGGCCGGGGG ACTGTTGGGCGCCATCTCCTTGCATGCACCATTCCTTGCGGCGGCGGTGCTCAA CGGCCTCAACCTACTACTGGGCTGCTTCCTAATGCAGGAGTCGCATAAGGGAGA GCGTCGACCGATGCCCTTGAGAGCCTTCAACCCAGTCAGCTCCTTCCGGTGGGC GCGGGGCATGACTATCGTCGCCGGCACTTATGACTGTCTTCTTTATCATGCAACT CGTAGGACAGGTGCCGGCAGCGCTCTGGGTCATTTTCGGCGAGGACCGCTTTCG CTGGAGCGCGACGATGATCGGCCTGTCGCTTGCGGTATTCGGAATCTTGCACGC CCTCGCTCAAGCCTTCGTCACTGGTCCCGCCACCAAACGTTTCGGCGAGAAGCA GGCCATTATCGCCGGCATGGCGGCCGACGCGCTGGGCTACGTCTTGCTGGCGTT CGCGACGCGAGGCTGGATGGCCTTCCCCATTATGATTCTTCTCGCTTCCGGCGG CATCGGGATGCCCGCGTTGCAGGCCATGCTGTCCAGGCAGGTAGATGACGACCA TCAGGGACAGCTTCAAGGATCGCTCGCGGCTCTTACCAGCCTAACTTCGATCAT TGGACCGCTGATCGTCACGGCGATTTATGCCGCCTCGGCGAGCACATGGAACGG GTTGGCATGGATTGTAGGCGCCGCCCTATACCTTGTCTGCCTCCCCGCGTTGCG TCGCGGTGCATGGAGCCGGGCCACCTCGACCTGAATGGAAGCCGGCGGCACCTC GCTAACGGATTCACCACTCCAAGAATTGGAGCCAATCAATTCTTGCGGAGAACT GTGAATGCGCAAACCAACCCTTGGCAGAACATATCCATCGCGTCCGCCATCTCC AGCAGCCGCACGCGGCGCATCTCGGGCAGCGTTGGGTCCTGGCCACGGGTGCGC ATGATCGTGCTCCTGTCGTTGAGGACCCGGCTAGGCTGGCTGGCGGGGTTGCCTTACT GGTTAGCAGAATGAATCACCGATACGCGAGCGAACGTGAAGCGACTGCTGCTGC AAAACGTCTGCGACCTGAGCAACAACATGAATGGTCTTCGGTTTCCGTGTTTCG TAAAGTCTGGAAACGCGGAAGTCAGCGCCCTGCACCATTATGTTCCGGATCTGC ATCGCAGGATGCTGCTGGCTACCCTGTGGAACACCTACATCTGTATTAACGAAG CGCTGGCCATCGACCCTGAGTGATTTTTCTCTGGTCCCGCCGCATCCATACCGCC AGTTGTTTACCCTCACAACGTTCCAGTAACCGGGCATGTTCATCATCAGTAACC CGTATCGTGAGCATCCTCTCTCGTTTCATCGGTATCATTACCCCCATGAACAGA AATCCCCCTTACACGGAGGCATCAGTGACCAAACAGGAAAAAACCGCCCTTAAC ATGGCCCGCTTTATCAGAAGCCAGACATTAACGCTTCTGGAGAAACTCAACGAG CTGGACGCGGATGAACAGGCAGACATCTGTGAATGCTTCACGACCACGTCGAT GAGCTTTACCGCAGCTGCCTCGCGCGTTTCGGTGATGACGGTGAAAACCTCTGA CACATGCAGCTCCCGGAGACGGTCACAGCTTGTCTGTAAGCGGATGCCGGGAGC AGACAAGCCCGTCAGGGCGCGTCAGCGGGTGTTGGCGGGTGTCGGGGCGCAGCC ATGACCCAGTCACGTAGCGATAGCGGAGTGTATACTGGCTTAACTATGCGGCAT CAGAGCAGATTGTACTGAGAGTGCACCACATGCGGTGTGAAATACCGCACAGAT GCGTAAGGAGAAAATACCGCATCAGGCGCTCTTCCGCTTCCTCGCTCACTGACT CGCTGCGCTCGGTCGTTCGGCTGCGGCGAGCGGTATCAGCTCACTCAAAGGCGG TAATACGGTTATCCACAGAATCAGGGGATAACGCAGGAAAGAACATGTGAGCAA AAGGCCAGCAAAAGGCCAGGAACCGTAAAAAGGCCGCGTTGCTGGCGTTTTTCC ATAGGCTCCGCCCCCTGACGAGCATCACAAAAATCGACGCTCAAGTCAGAGGT GGCGAAACCCGACAGGACTATAAAGATACCAGGCGTTTCCCCCTGGAAGCTCCC TCGTGCGCTCTCCTGTTCCGACCCTGCCGCTTACCGGATACCTGTCCGCCTTTC TCCCTTCGGGAAGCGTGGCGCTTTCTCATAGCTCACGCTGTAGGTATCTCAGTT CGGTGTAGGTCGTTCGCTCCAAGCTGGGCTGTGTGCACGAACCCCCCGTTCAGC CCGACCGCTGCGCCTTATCCGGTAACTATCGTCTTGAGTCCAACCCGGTAAGAC ACGACTTATCGCCACTGGCAGCAGCCACTGGTAACAGGATTAGCAGAGCGAGGT ATGTAGGCGGTGCTACAGAGTTCTTGAAGTGGTGGCCTAACTACGGCTACACTA GAAGGACAGTATTTGGTATCTGCGCTCTGCTGAAGCCAGTTACCTTCGGAAAAA GAGTTGGTAGCTCTTGATCCGGCAAACAAACCACCGCTGGTAGCGGTGGTTTTT TTGTTTGCAAGCAGCAGATTACGCGCAGAAAAAAAGGATCTCAAGAAGATCCTT TGATCTTTTCTACGGGGTCTGACGCTCAGTGGAACGAAAACTCACGTTAAGGGA TTTTGGTCATGAGATTATCAAAAAGGATCTTCACCTAGATCCTTTTAAATTAAA AATGAAGTTTTAAATCAATCTAAAGTATATATGAGTAAACTTGGTCTGACAGTT AATTAAGAAAGTTAATCTTTTCAACAGCTGTCATAAAGTTGTCACGGCCGAGAC TTATAGTCGCTTTGTTTTTATTTTTTAATGTATTTGTAACTAGTACGCAAGTTC | SPAGSPTSTEEGTSESAT PESGPGTSTEPSEGSAPG TSESATPESGPGSEPATS GSETPGTSESATPESGPG SEPATSGSETPGTSESAT PESGPGTSTEPSEGSAPG SPAGSPTSTEEGTSESAT PESGPGSEPATSGSETPG TSESATPESGPGSPAGSP TSTEEGSPAGSPTSTEEG TSTEPSEGSAPGTSESAT PESGPGTSESATPESGPG TSESATPESGPGSEPATS GSETPGSEPATSGSETPG SPAGSPTSTEEGTSTEPS EGSAPGTSTEPSEGSAPG GSAPTTGEAGEAAGATSA GATGPATSGSETPGTDIQ MTQSPSSLSASVGDRVTI TCRSTKSLLHSNGITYLY WYQQKPGKAPKLLIYQMS NLASGVPSRFSSSGSGTD FTLTISSLQPEDFATYYC AQNLEIPRTFGQGTKVEI KGATPPETGAETESPGET TGGSAESEPPGEGQVQLV QSGPGLVQPGGSVRISCA ASGYTFTNYGMNWVKQAP GKGLEWMGWINTYTGEST YADSFKGRFTFSLDTSAS AAYLQINSLRAEDTAVYY CARFAIKGDYWGQGTLLT VSSGGGGSDIQMTQSPSS LSASVGDRVTITCRASQD IRNYLNWYQQKPGKAPKL LIYYTSRLESGVPSRFSG SGSGTDYTLTISSLQPED FATYYCQQGNTLPWTFGQ GTKVEIKGATPPETGAET ESPGETTGGSAESEPPGE GEVQLVESGGGLVQPGGS LRLSCAASGYSFTGYTMN WVRQAPGKGLEWVALINP YKGVSTYNQKFKDRFTIS VDKSKNTAYLQMNSLRAE DTAVYYCARSGYYGDSDW YFDVWGQGTLVTVSSGTA EAASASGTTGEAGEAAGA TSAGATGPSPGSPAGSPT STEEGTSESATPESGPGT STEPSEGSAPGSPAGSPT STEEGTSTEPSEGSAPGT STEPSEGSAPGTSESATP ESGPGSEPATSGSETPGS EPATSGSETPGSPAGSPT STEEGTSESATPESGPGT STEPSEGSAPGTSTEPSE GSAPGSPAGSPTSTEEGT STEPSEGSAPGTSTEPSE GSAPGTSESATPESGPGT STEPSEGSAPGTSESATP ESGPGSEPATSGSETPGT STEPSEGSAPGTSTEPSE |

TABLE 18-continued

DNA and amino acid sequence of ProTIA constructs of Example 45

| Construct Name | DNA Sequence | Amino Acid Sequence* |
|---|---|---|
| | ACGTAAAAAGGGTATCTAGACATATGAAGAAAAACATCGCTTTTCTTCTTGCAT<br>CTATGTTCGTTTTTTCTATTGCTACAAACGCGTACGCTTCCCCAGCAGGCAGCC<br>CGACCAGCACCGAGGAGGGTACGAGCGAGTCGGCTACTCCAGAGAGCGGTCCGG<br>GTACCTCTACGGAACCGTCCGAAGGTAGCGCTCCAGGCACGTCTGAAAGCGCGA<br>CGCCGGAAAGCGGTCCAGGCAGCGAGCCGGCGACCTCCGGTAGCGAAACGCCTG<br>GTACCTCGGAGTCAGCGACTCCGGAAAGCGGTCCGGGTAGCGAACCTGCAACGA<br>GCGGTAGCGAGACTCCAGGCACTAGCGAATCCGCAACTCCGGAGTCGGGTCCGG<br>GCACCTCTACGGAGCCTAGCGAGGGCTCAGCACCAGGTAGCCCTGCAGGTTCCC<br>CGACGTCAACCGAGGAAGGTACAAGCGAAAGCGCCACCCCTGAGTCGGGCCCTG<br>GCAGCGAACCGGCAACTAGCGGCAGCGAGACTCCGGGTACCAGCGAGTCTGCTA<br>CGCCAGAGAGCGGCCCAGGTTCGCCAGCGGGTTCGCCGACTAGCACGGAGGAGG<br>GCAGCCCAGCGGGTAGCCCGACCAGCACTGAGGAGGGTACGTCCACCGAACCGA<br>GCGAAGGTAGCGCACCAGGTACCTCCGAGTCTGCCACCCCTGAATCCGGTCCAG<br>GTACCAGCGAATCAGCCACCCCGGAGTCGGGTCCAGGTACGAGCGAATCTGCTA<br>CCCCGGAATCCGGCCCAGGCAGCGAACCTGCTACTAGCGGCAGCGAAACGCCGG<br>GCAGCGAACCTGCCACGTCAGGCAGCGAGACGCCGGGTTCCCCTGCAGGCTCCC<br>CGACCAGCACTGAGGAGGGCACCTCCACCGAACCATCAGAAGGTAGCGCGCCTG<br>GTACGTCAACCGAACCTTCCGAGGGCAGCGCACCGGGTGGCTCAGCGCCTACTA<br>CAGGGGAGGCGGGGAAGCAGCAGGGGCGACTTCGCTGGGGCTACCGGCCCCG<br>CTACCTCAGGCTCCGAAACCCCAGGCACCGATATCCAGATGACCCAGAGCCCTT<br>CTTCCCTGTCCGCATCCGTCGGCGATCGTGTCACGATTACCTGTCGCAGCACTA<br>AGAGCCTGCTGCACTCAAACGGTATCACGTACCTGTACTGGTACCAGCAGAAGC<br>CGGGCAAAGCGCCGAAGCTGCTGATTTATCAGATGAGCAACCTGGCATCGGGCG<br>TGCCGAGCCGTTTCAGCAGCAGCGGTAGCGGTACCGACTTCACGCTGACCATCA<br>GCTCGTTGCAGCCAGAGGACTTTGCGACGTACTATTGTGCGCAAAACTTGGAAA<br>TTCCGCGCACCTTCGGCCAGGGTACGAAAGTTGAGATTAAAGGTGCCACCCCAC<br>CGGAGACTGGTGCAGAAACCGAGTCTCCGGGCGAAACCACGGGCGGTAGCGCGG<br>AGAGCGAACCGCCTGGTGAGGGTCAAGTTCAATTGGTTCAGAGCGGTCCGGGTC<br>TGGTTCAACCGGGCGGCAGCGTGCGCATTTCTTGTGCGGCCAGCGGTTACACCT<br>TTACGAACTACGGTATGAATTGGGTGAAACAAGCTCCGGGCAAAGGTCTGGAGT<br>GGATGGGTTGGATCAATACCTATACCGGTGAATCCACTTACGCGGATTCCTTTA<br>AGGGCCGTTTCACCTTCAGCCTGGACACGAGCGCGAGCGCTGCATATCTGCAAA<br>TCAATAGCCTGCGTGCCGAAGATACCGCGGTGTACTATTGCGCGCGTTTTGCAA<br>TCAAGGGCGACTATTGGGGTCAAGGCACGCTGCTGACCGTGAGCAGCGGTGGTG<br>GCGGCAGCGATATCCAAATGACCCAATCCCCATCCTCCCTGTCTGCAAGCGTTG<br>GTGATCGTGTGACGATTACGTGCCGTGCCTCCCAAGATATCCGTAACTACCTGA<br>ATTGGTATCAGCAGAAACCGGGCAAGGCTCCGAAATTGCTGATCTACTACACCA<br>GCCGCCTGGAGTCGGGTGTGCCTAGCCGCTTCAGCGGCAGCGGTTCGGGTACCG<br>ACTATACCTTGACCATTAGCAGCCTGCAGCCGGAAGATTTCGCGACGTATTACT<br>GCCAACAGGGTAACACGCTGCCGTGGACCTTTGGCCAAGGTACCAAAGTCGAGA<br>TTAAGGGTGCGACCCCGCCGGAAACCGGTGCGGAAACCGGTCCGGGTGAAA<br>CGACTGGCGGCTCTGCAGAGAGCGAGCCGCCAGGTGAGGGCGAAGTCCAACTGG<br>TCGAGTCTGGTGCGGCCTGGTGCAACCGGGTGGCAGCCTGCGTCTGAGCTGCG<br>CTGCGAGCGGCTATAGCTTTACCGGTTATACCATGAACTGGGTTCGCCAGGCAC<br>CGGGTAAGGGTCTGGAATGGGTGGCGCTGATCAATCCGTACAAAGGTGTGAGCA<br>CTTACAATCAGAAATTCAAAGACCGTTTCACCATTAGCGTTGACAAGAGCAAGA<br>ATACCGCGTATCTGCAGATGAACAGCTTGCGCGCCGAGGATACGGCCGTTTACT<br>ACTGTGCACGTAGCGGCTATTACGGTGACAGCGACTGGTACTTTGACGTCTGGG<br>GTCAGGGCACGCTGGTCACCGTTAGCAGCGGCACCGCCGAAGCAGCTAGCGCCT<br>CTGGCACGACTGGTGAAGCCGGAGAGGCAGCTGGCGCGACCTCAGCGGGGCTA<br>CTGGGCCTTCTCCAGGTAGCCCAGCTGGTAGCCCAACCTCTACCGAAGAAGGTA<br>CCTCTGAATCCGCTACTCCAGAATCCGGTCCTGGTACTAGCACTGAGCCAAGCG<br>AAGGTTCTGCTCCAGGCTCCCCGGCAGGTAGCCCTACCTCTACCGAAGAGGGCA<br>CTAGCACCGAACCATCTGAGGGTTCCGCTCCTGGCACCTCCACTGAACCGTCCG<br>AAGGCAGTGCTCCGGGTACTTCCGAAAGCGCAACTCCGGAATCCGGCCCTGTT<br>CTGAGCCTGCTACTTCCGGCTCTGAAACTCCAGGTAGCGAGCCAGCGACTTCTG<br>GTTCTGAAACTCCAGGTTCACCGGCGGGTAGCCCGACGAGCACGGAGGAAGGTA<br>CCTCTGAGTCGGCCACTCCTGAGTCCGGTCCGGGCACGAGCACCGAGCCGAGCG<br>AGGGTTCAGCCCCGGGTACCAGCACGGAGCCGTCCGAGGGTAGCGCACCGGGTT<br>CTCCGGCGGGCTCCCCTACGTCTACGGAAGAGGGTACGTCCACTGAACCTAGCG<br>AGGGCAGCGCGCCAGGCACCAGCACTGAACCGAGCGAAGGCAGCGCACCTGGCA<br>CTAGCGAGTCTGCGACTCCGGAGAGCGGTCCGGGTACGAGCACGGAACCAAGCG<br>AAGGCAGCGCCCCAGGTACCTCTGAATCTGCTACCCCAGAATCTGGCCCGGGTT<br>CCGAGCCAGCTACCTCTGGTTCTGAAACCCCAGGTACTTCCACTGAACCAAGCG<br>AAGGTAGCGCTCCTGGCACTTCTACTGAACCATCCGAAGGTTCCGCTCCTGGTA<br>CGTCTGAAAGCGCTACCCCTGAAAGCGGCCCAGGCACCTCTGAAAGCGCTACTC<br>CTGAGAGCGGTCCAGGCTCTCAGCAGGTTCTCCAACCTCCACTGAAGAAGGCA<br>CCTCTGAGTCTGCTACCCCTGAATCTGGTCCTGGCTCCGAACCTGCTACCTCTG<br>GTTCCGAAACTCCAGGTACCTCGGAATCTGCGACTCCGGAATCTGGCCCGGGCA<br>CGAGCACGGAGCCGTCTGAGGGTAGCGCACCAGGTACAAGCACCGAACCGTCCG<br>AGGGCTCTGCACCGGGTACCTCCACGGAACCTTCGGAAGGTTCTGCGCCGGGTA<br>CCTCCACTGAGCCATCCGAGGGTTCAGCACCAGGTACTAGCACGGAACCGTCCG<br>AGGGCTCTGCACCAGGTACGAGCACCGAACCGTCGGAGGGTAGCGCTCCAGGTA<br>GCCCAGCGGGCTCTCCGACAAGCACCGAAGAAGGCACCAGCACCGAGCCGTCCG<br>AAGGTTCCGCACCAGGTACAAGCGAGAGCGCGACTCCTGAATCTGGTCCGGGTA | GSAPGTSESATPESGPGT<br>SESATPESGPGSPAGSPT<br>STEEGTSESATPESGPGS<br>EPATSGSETPGTSESATP<br>ESGPGTSTEPSEGSAPGT<br>STEPSEGSAPGTSTEPSE<br>GSAPGTSTEPSEGSAPGT<br>STEPSEGSAPGTSTEPSE<br>GSAPGSPAGSPTSTEEGT<br>STEPSEGSAPGTSESATP<br>ESGPGSEPATSGSETPGT<br>SESATPESGPGSEPATSG<br>SETPGTSESATPESGPGT<br>STEPSEGSAPGTSESATP<br>ESGPGSPAGSPTSTEEGS<br>PAGSPTSTEEGSPAGSPT<br>STEEGTSESATPESGPGT<br>STEPSEGSAPGTSESATP<br>ESGPGSEPATSGSETPGT<br>SESATPESGPGSEPATSG<br>SETPGTSESATPESGPGT<br>STEPSEGSAPGSPAGSPT<br>STEEGTSESATPESGPGS<br>EPATSGSETPGTSESATP<br>ESGPGSPAGSPTSTEEGS<br>PAGSPTSTEEGTSTEPSE<br>GSAPGTSESATPESGPGT<br>SESATPESGPGTSESATP<br>ESGPGSEPATSGSETPGS<br>EPATSGSETPGSPAGSPT<br>STEEGTSTEPSEGSAPGT<br>STEPSEGSAPGSEPATSG<br>SETPGTSESATPESGPGT<br>STEPSEGSAPGHHHHHH<br>(SEQ ID NO.: 1018) |

TABLE 18-continued

DNA and amino acid sequence of ProTIA constructs of Example 45

| Construct Name | DNA Sequence | Amino Acid Sequence* |
|---|---|---|
| | GCGAGCCTGCAACCAGCGGTTCTGAGACGCCGGGCACTTCCGAATCTGCGACCC<br>CGGAGTCCGGTCCAGGTTCAGAGCCGGCGACGAGCGGTTCGGAAACGCCGGGTA<br>CGTCTGAATCAGCCACGCCGGAGTCTGGTCCGGGTACCTCCGACCGAACCAAGCG<br>AAGGTTCGGCACCGGGTACTAGCGAGAGCGCAACCCCTGAAAGCGGTCCGGGCA<br>GCCCGGCAGGTTCTCCAACCAGCACCGAAGAAGGTTCCCCTGCTGGTAGCCCGA<br>CCTCTACGGAGGAAGGTAGCCCTGCAGGTTCCCCAACTTCTACTGAGGAAGGTA<br>CTTCTGAGTCCGCTACCCCAGAAAGCGGTCCTGGTACCTCCACTGAACCGTCTG<br>AAGGCTCTGCACCAGGCACTTCTGAGTCTGCTACTCCAGAAAGCGGCCCAGGTT<br>CTGAACCAGCAACTTCTGGCTCTGAGACTCCAGGCACTTCTGAGTCCGAACGC<br>CTGAATCCGGTCCTGGTTCTGAACCAGCTACTTCCGGCAGCGAAACCCCAGGTA<br>CCTCTGAGTCTGCGACTCCAGAGTCTGGTCCTGGTACTTCCACTGAGCCTAGCG<br>AGGGTTCCGCACCAGGTTCTCCGGCTGGTAGCCCGACCAGCACGGAGGAGGGTA<br>CGTCTGAATCTGCAACGCCGGAATCGGGCCCAGGTTCGGAGCCTGCAACGTCTG<br>GCAGCGAAACCCCGGGTACCTCCGAATCTGCTACACCGGAAAGCGGTCCTGGCA<br>GCCCTGCTGGTTCTCCAACCTCTACCGAGGAGGGTTCACCGGCAGGTAGCCCGA<br>CTAGCACTGAAGAAGGTACTAGCACGGAGCCGAGCGAGGGTAGTGCTCCGGGTA<br>CGAGCGAGAGCGCAACGCCAGAGAGCGGTCCAGGCACCAGCGAATCGGCCACCC<br>CTGAGAGCGGCCCAGGTACTTCTGAGAGCGCCACTCCTGAATCCGGCCCTGGTA<br>GCGAGCCGGCAACCTCCGGCTCAGAAACTCCTGGTTCGGAACCAGCGACCAGCG<br>GTTCTGAAACTCCGGGTAGCCCGGCAGGCAGCCCAACGAGCACCGAAGAGGGTA<br>CCAGCACGGAACCGAGCGAGGGTTCTGCCCCGGGTACTTCCACCGAACCATCGG<br>AGGGCTCTGCACCTGGTAGCGAACCTGCGACGTCTGGTTCTGAAACGCCGGGTA<br>CCAGCGAAAGCGCTACCCCAGAATCCGGTCCGGGCACTAGCACCGAGCCATCGG<br>AGGGCTCCGCACCAGGTCACCATCATCACCATCACTAAACTAGTTAAAAGCATG<br>CGGCCGCCTAGCATAACCCCTTGGGGCCTCTAAACGGGTCTTGAGGGGTTTTTT<br>GTTGGCGCGCCGGAAATACAGGAACGCACGCTGGATGGCCCTTCGCTGGGATGG<br>TGAAACCATGAAAAATGGCAGCTTCAGTGGATTAAGTGGGGGTAATGTGGCCTG<br>TACCCTCTGGTTGCATAGGTATTCATACGGTTAAAATTTATCAGGCGCGATCGC<br>GGCAGTTTTTCGGGTGGTTTGTTGCCATTTTTACCTGTCTGCTGCCGTGATCGC<br>GCTGAACGCGTTTTAGCGGTGCGTACAATTAAGGGATTATGGTAAATCCACTTA<br>CTGTCTGCCCTCGTAGCCATCGAA<br>(SEQ ID NO.: 1008) | |
| AC1955 | ATGAAGAAAAACATCGCTTTTCTTCTTGCATCTATGTTCGTTTTTTCTATTGCT<br>ACAAACGCGTACGCTCACCATCATCACCATCACTCCCCAGCAGGCAGCCCCGACC<br>AGCACCGAGGAGGGTACGAGCGAGTCGGCTACTCCAGAGAGCGGTCCGGGTACC<br>TCTACGGAACCGTCCGAAAGGTAGCGCTCCAGGCACCGTCTGAAACGCGACGCCG<br>GAAAGCGGTCCAGGCAGCGAGCCGGCGACCTCCGGTAGCGAAACGCCTGGTACC<br>TCGGAGTCAGCGACTCCGGAAAGCGGTCCGGGTAGCGAACCTGCAACGAGCGGT<br>AGCGAGACTCCAGGCACTAGCGAATCCGCAACTCCGGAGTCGGGTCCGGGCACC<br>TCTACGGAGCCTAGCGAGGGTCAGCACCAGGTAGCGTCTGCAGGTTCCCGAGA<br>TCAACCGAGGAAGGTACAAGCGAAAGCGCCACCCCTGAGTCGGGCCCTGGCAGC<br>GAACCGGCAACTAGCGGCAGCGAGACTCCGGGTACCAGCGAGTCTGCTACGCCA<br>GAGAGCGGCCCAGGTTCGCCAGCGGGTTCGCCGACTAGCACGGAGGAGGGCAGC<br>CCAGCGGGTAGCCGACCAGCACTGAGAGGGTACGTCCACCGAACCAGCGAA<br>GGTAGCGCACCAGGTACCTCCGAGTCTGCCACCCCTGAATCCGGTCCAGGTACC<br>AGCGAATCAGCCACCCCGGAGTCGGGTCCAGGTACGAGCGAATCTGCTACCCCG<br>GAATCCGGCCCAGGCAGCGAACCTGCTACTAGCGGCAGCGAAACGCCGGGCAGC<br>GAACCTGCCACGTCAGGCAGCGAGCAGCGCGGGTTCCCCTGCAGGCTCCCCGACC<br>AGCACTGAGGAGGCACCTCCACCGAACCATCAGAAGGTAGCGCGCCTGGTACG<br>TCAACCGAACCTTCCGAGGGCAGCGCACCGGGTGGCTCAGCGCCTGAGGCAGGT<br>CGTTCTGCTAACCATACCCCAGCGGGGCTGACTGGGCCTGCTACCTCAGGCTCC<br>GAAACCCGGGCACCGACATCCAAATGACCCAGAGCCCAGCAGCCTGAGCGCG<br>AGCGTGGGCGACCGTGTTACCATCACCTGCCAAGCGAGCCAAGACATCAGCAAC<br>TACCTGAACTGGTATCAGCAAAAGCCGGGCAAAGCGCCGAAGCTGCTGATCTAC<br>GACGCGAGCAACCTGGAAACCGGTGTGCCGAGCCGTTTCAGCGGTAGCGGTAGC<br>GGTACCGATTTCACCTTTACCATCAGCAGCCTGCAACCGGAGGACATCGCGACC<br>TATTTCTGCCAGCACTTTGATCACCTGCCGCTGGCGTTTGGTGGCGGTACCAAA<br>GTTGAGATTAAAGGTGCAACGCCTCCGGAGACTGGTGCTGAAACTGAGTCCCCG<br>GGCGAGACGACCGGTGGCTCTGCTGAATCCGAACCACCGGGCGAAGGCCAGGTG<br>CAACTGCAGGAAAGCGGTCCGGGCCTGGTTAAACCGAGCGAAACCCTGAGCCTG<br>ACCTGCACCGTGAGCGGCGGTAGCGTTAGCAGCGGTGACTACTATTGGACCTGG<br>ATCCGTCAAAGCCCGGGTAAAGGCCTGGAGTGGATCGGTCACATTTACTATAGC<br>GGCAACACCAACTACAACCCGAGCCTGAAGAGCCGTCTGACCATCAGCATTGAC<br>ACCAGCAAAACCCAGTTCAGCCTGAAACTGAGCAGCGTGACCGCGGCGGATACC<br>GCGATTTACTATTGCGTTCGTGATCGTGTTACCGGCGCGTTCGACATCTGGGGT<br>CAGGGCACCATGGTTACCGTTAGCAGCGGTGGTGGCGGCAGCGAGTTAGTTGTG<br>ACCCAAGAGCCGAGCCTGACCGTTAGCCCGGGTGGTACGGTCACCCTGACGTGC<br>CGTAGCAGCACCGGTGCGGTCACGACCAGCAACTATGCCAATTGGGTCCAGCAG<br>AAACCGGGTCAAGCACCGGTTCGCCTGATCGGCGCACCAATAAACGTGCCCCG<br>GGTACTCCTGCGCGTTTCTCCGGTAGCCTGCTGGGCGGCAAAGCCGCTCTGACC<br>CTGAGCGGTGTCCAGCCGGAAGATGAAGCGGAGTACTACTGCGCGCTGTGGTAT<br>TCCAATCTGTGGGTTTTTGGCGGCGGTACCAAGCTGACCGTATTGGGTGCTACG<br>CCACCCGGAGACTGGCGCAGAAACGGAAAGCCCGGGTGAGACTACGGGTGGCTCT<br>GCGGAGAGCGAACCTCCGGGTGAGGGTGAGGTCCAACTGCTGGAGTCGGTGGT | HHHHHHSPAGSPTSTEEG<br>TSESATPESGPGTSTEPS<br>EGSAPGTSESATPESGPG<br>SEPATSGSETPGTSESAT<br>PESGPGSEPATSGSETPG<br>TSESATPESGPGTSTEPS<br>EGSAPGSPAGSPTSTEEG<br>TSESATPESGPGSEPATS<br>GSETPGTSESATPESGPG<br>SPAGSPTSTEEGSPAGSP<br>TSTEEGTSTEPSEGSAPG<br>TSESATPESGPGTSESAT<br>PESGPGTSESATPESGPG<br>SEPATSGSETPGSEPATS<br>GSETPGSPAGSPTSTEEG<br>TSTEPSEGSAPGTSTEPS<br>EGSAPGGSAPEAGRSANH<br>TPAGLTGPATSGSETPGT<br>DIQMTQSPSSLSASVGDR<br>VTITCQASQDISNYLNWY<br>QQKPGKAPKLLIYDASNL<br>ETGVPSRFSGSGSGTDFT<br>FTISSLQPEDIATYFCQH<br>FDHLPLAFGGGTKVEIKG<br>ATPPETGAETESPGETTG<br>GSAESEPPGEGQVQLQES<br>GPGLVKPSETLSLTCTVS<br>GGSVSSGDYYWTWIRQSP<br>GKGLEWIGHIYYSGNTNY<br>NPSLKSRLTISIDTSKTQ<br>FSLKLSSVTAADTAIYYC<br>VRDRVTGAFDIWGQGTMV<br>TVSSGGGGSELVVTQEPS<br>LTVSPGGTVTLTCRSSTG<br>AVTTSNYANWVQQKPGQA<br>PRGLIGGTNKRAPGTPAR<br>FSGSLLGGKAALTLSGVQ<br>PEDEAEYYCALWYSNLWV<br>FGGGTKLTVLGATPPETG<br>AETESPGETTGGSAESEP<br>PGEGEVQLLESGGGLVQP<br>GGSLKLSCAASGFTFNTY |

TABLE 18-continued

DNA and amino acid sequence of ProTIA constructs of Example 45

| Construct Name | DNA Sequence | Amino Acid Sequence* |
|---|---|---|
| | GGCCTGGTTCAACCGGGTGGCTCGTTGAAGCTGAGCTGTGCAGCTAGCGGCTTT ACCTTCAACACCTATGCGATGAATTGGGTTCGTCAGGCACCGGGTAAGGGCCTG GAATGGGTGGCGCGTATCCGCTCCAAGTACAACAACTACGCGACCTACTACGCG GATAGCGTTAAAGACCGCTTCACGATTAGCCGTGACGATTCCAAGAATACGGCA TATCTGCAAATGAACAATCTGAAAACCGAAGATACCGCGGTGTATTACTGTGTG CGCCACGGCAATTTCGGCAACAGCTACGTGAGCTGGTTTGCATATTGGGGTCAG GGCACCCTGGTTACGGTGAGCTCCGGCACCGCCGAAGCAGCTAGCGCCTCTGGC GAGGCAGGTCGTTCTGCTAACCATACCCCAGCGGGGCTGACTGGGCCTCCAGGT AGCCCAGCTGGTAGCCCAACCTCTACCGAAGAAGGTACCTCTGAATCCGCTACT CCAGAATCCGGTCCTGGTACTAGCACTGAGCCAAGCGAAGGTTCTGCTCCAGGC TCCCCGGCAGGTAGCCCCTACCTCTACCGAAGAGGGCACTAGCACCGAACCATCT GAGGGTTCCGCTCCTGGCACCTCCACTGAACCAGCAGTGCTCCAGGGT ACTTCCGAAAGCGCAACTCCGGAATCCGGCCCTGGTTCTGAGCCTGCTACTTCC GGCTCTGAAACTCCAGGTAGCGAGCCAGCGACTTCTGGTTCTGAAACTCCAGGT TCACCGGCGGGTAGCCCGACGAGCACGGAGGAAGGTACCTCTGAGTCGGCCACT CCTGAGTCCGGTCCGGGCACGAGCCACGAGCCGAGCGAGGGTTCCGCCCGGGT ACCAGCACGGAGCCGTCCGAGGGTAGCGACCCGGGTTCTCCGGCGGGCTCCCCT ACGTCTACGGAAGAGGGTACGTCCACTGAACCTAGCGAGGGCAGCGCGCCAGGC ACCAGCACTGAACCGAGCGAAGGCAGCGCACCTGGCACTAGCGAGTCTGCGACT CCGGAGAGCGGTCCGGGTACGAGCACGAGCAAGCGAAGGCAGCGCCCCAGGT ACCTCTGAATCTGCTACCCAGATCTGGCCCGGGTTCCGAGCCAGCTACCTCT GGTTCTGAAACCCCAGGTACTTCCACTGAACAAGCGAAGGTAGCGCTCCTGGC ACTTCTACTGAACCATCCGAAGGTTCCGCTCCTGGTACGTCTGAAAGCGCTACC CCTGAAAGCGGCCCAGGCACCTCTGAAAGCGCTACTCCTGAGAGCGGTCCAGGC TCTCCAGCAGGTTCTCCAACCTCCACTGAAGAAGGCACCTCTGAGTCTGCTACC CCTGAATCTGGTCCTGGCTCCGAACCTGCTACCTCTGGTTCCGAAACTCCAGGT ACCTCGGAATCTGCGACTCCGGAATCTGGCCCGGGCACGAGCACGGAGCCGTCT GAGGGTAGCGCACCAGGTACCAGCACTGAGCCTTCTGAGGGCTCTGCACCGGGT ACCTCCACGGAACCTTCGGAAGGTTCTGCGCCGGGTACCTCCACTGAGCCATCC GAGGGTTCAGCACCAGGTACTAGCACGGAACCGTCCGAGGGCTCTGCACCAGGT ACGAGCACCGAACCGTCGGAGGGTAGCGCTCCAGGTAGCCCAGCGGGCTCTCCG ACAAGCACCGAAGAAGGCACCAGCACGAGCCGTCCGAAGGTTCCGCACCAGGT ACAAGCGAGAGCGCGACTCCTGAATCTGGTCCGGGTAGCGAAGCCTGCAACCAG GGTTCTGAGACGCCGGGCACTTCCGAATCTGCGACCCCGGAGTCCGGTCCAGGT TCAGAGCCGGCGACGAGCGGTTCGGAAACGCCGGGTACGTCTGAATCAGCCACG CCGGAGTCTGGTCCGGGTACCTCGACCGAACCAAGCGAAGGTTCGGCACCGGGT ACTAGCGAGAGCGCAACCCCTGAAGACGGAGGGCCAGGCAGCCAGGTTCTCCA ACCAGCACCGAAGAAGGTTCCCCTGCTGGTAGCCCGACCTCTACGGAGGAAGGT AGCCCTGCAGGTTCCCCAACTTCTACTGAGGAAGGTACTTCTGAGTCCGCTACC CCAGAAAGCGGTCCTGGTACCTCCACTGAACCGTCTGAAGGCTCTGCACCAGGC ACTTCTGAGTCTGCTACTCCAGAAAGCGGCCCAGGTTCTGAACCAGCAACTTCT GGCTCTGAGACTCCAGGCACTTCTGAGTCCGAACGCCTGAATCCGGTCCTGGT TCTGAACCAGCTACTTCCGGCAGCGAAACCCCAGGTACCTCTGAGTCTGCGACT CCAGAGTCTGGTCCTGGTACTTCCACTGAGCCTAGCGAGGGTTCCGCACCAGGT TCTCCGGCTGGTAGCCCGACCACGAGCACGGAGGGTACGTCTGAATCTGCAACG CCGGAATCGGGCCCAGGTTCGGAGCCTGCAACGTCTGGCAGCGAAACCCCGGGT ACCTCCGAATCTGCTACACCGGAAAGCGGTCCTGGCAGCCCTGCTGGTTCTCCA ACCTCTACCGAGGAGGGTTCACCGGCAGGTAGCCCGACTAGCACTGAAGAAGGT ACTAGCGAGAGCGCTACCCCGGAAAGCGGCACCGGGCCAGGCACCAGCGAATCGGCCACCCCTGAGAGCGGCCCAGGT ACTTCTGAGAGCGCCACTCCTGAATCCGGCCCTGGTAGCGAGCCGGCAACCTCC GGCTCAGAAACTCCTGGTTCGGAACCAGCGACCAGCGGTTCTGAAACTCCGGGT AGCCCGGCAGGCAGCCCAACGAGCACCGAAGAGGGTACCAGCACCGAGCCGAGC GAGGGTTCTGCCCCGGGTACTTCCACCGAACCATCGGAGGGCTCTGCACCTGGT AGCGAACCTGCGACGTCTGGTTCTGAAACGCCGGGTACCAGCGAAAGCGCTACC CCAGAATCCGGTCCGGGCACTAGCACCGAGCCATCGGAGGGCGCCGCAGAACCA GAGGCG<br>(SEQ ID NO.: 1009) | AMNWVRQAPGKGLEWVAR IRSKYNNYATYYADSVKD RFTISRDDSKNTAYLQMN NLKTEDTAVYYCVRHGNF GNSYVSWFAYWGQGTLVT VSSGTAEAASASGEAGRS ANHTPAGLTGPPGSPAGS PTSTEEGTSESATPESGP GTSTEPSEGSAPGSPAGS PTSTEEGTSTEPSEGSAP GTSTEPSEGSAPGTSESA TPESGPGSEPATSGSETP GSEPATSGSETPGSPAGS PTSTEEGTSESATPESGP GTSTEPSEGSAPGTSTEP SEGSAPGSPAGSPTSTEE GTSTEPSEGSAPGTSTEP SEGSAPGTSESATPESGP GTSTEPSEGSAPGTSESA TPESGPGSEPATSGSETP GTSTEPSEGSAPGTSTEP SEGSAPGTSESATPESGP GTSESATPESGPGSPAGS PTSTEEGTSESATPESGP GSEPATSGSETPGTSESA TPESGPGSTEPSEGSAP GTSTEPSEGSAPGTSTEP SEGSAPGTSTEPSEGSAP GTSTEPSEGSAPGTSTEP SEGSAPGSPAGSPTSTEE GTSTEPSEGSAPGTSESA TPESGPGSEPATSGSETP GTSESATPESGPGSEPAT SGSETPGTSESATPESGP GTSTEPSEGSAPGTSESA TPESGPGSPAGSPTSTEE GSPAGSPTSTEEGSPAGS PTSTEEGTSESATPESGP GTSTEPSEGSAPGTSESA TPESGPGSEPATSGSETP GTSESATPESGPGSEPAT SGSETPGTSESATPESGP GTSTEPSEGSAPGSPAGS PTSTEEGTSESATPESGP GSEPATSGSETPGTSESA TPESGPGSPAGSPTSTEE GSPAGSPTSTEEGSPAGS PTSTEEGTSESATPESGP GTSESATPESGPGSESA TPESGPGSEPATSGSETP GSEPATSGSETPGSPAGS PTSTEEGTSTEPSEGSAP GTSTEPSEGSAPGSEPAT SGSETPGTSESATPESGP GTSTEPSEGSAPGEPEA (SEQ ID NO.: 1019) |
| AC2009 | ATGAAGAAAAACATCGCTTTTCTTCTTGCATCTATGTTCGTTTTTCTATTGCT ACAAACGCGTACGCTCACCATCATCACCATCACTCCCAGCAGGCAGCCCGACC AGCACCGAGGAGGGTACCAGCGAATCTGCTACTCCAGAGTCCGGGGTACC TCTACGGAACCGTCCGAAGGTAGCGCTCCAGGCACGTCTGAAAGCGCTGACGCG GAAAGCGGTCCAGGCAGCGAGCCGGCGACCTCCGGTAGCGAAACGCCTGGTACC TCGGAGTCAGCGACTCCGGAAAGCGGTCCGGGTAGCGAACCTGCAACGAGCGGT AGCGAGTCCAGCACTGAGGAATCTCCGGAGTCGGGTCCGGGACCGCTCCCC TCTACGGAGCCTAGCGAGGGCTCAGCACCAGGTAGCCCTGCAGGTTCCCCGACG TCAACCGAGGAAGGTACAAGCGAAAGCGCCACCCCTGAGTCGGGCCCTGGCAGC GAACCGGCAACTAGCGGCAGCGAGACTCCGGGTACCAGCGAGTCTGCTACGCCA GAGAGCGGCCCCAGGTTCGCCAGCGAGGTTCGCCAGCGGAGGAGGCGCC CCAGCGGGTAGCCCCGACCAGCACTGAGGAGGGTACGTCCACCGAACCGAGCGAA GGTAGCGCACCAGGTACCTCCGAGTCTGCCACCCCTGAATCCGGTCCAGGTACC AGCGAATCAGCCACCCCGGAGTCGGGTCCAGGTACGAGCGAATCTGCTACCCCG GAATCCGGCCCAGGCAGCGAACCTGCTACTAGCGGCAGCGAAACGCCGGGCAGC GAACCTGCCACGTCAGGCAGCGAGACGCCGGGTTCCCCTGCAGGCTCCCCGACC | HHHHHHSPAGSPTSTEEG TSESATPESGPGTSTEPS EGSAPGTSESATPESGPG SEPATSGSETPGTSESAT PESGPGSEPATSGSETPG TSESATPESGPGTSTEPS EGSAPGSPAGSPTSTEEG TSESATPESGPGSEPATS GSETPGTSESATPESGPG SPAGSPTSTEEGSPAGSP TSTEEGTSTEPSEGSAPG TSESATPESGPGTSESAT PESGPGTSESATPESGPG SEPATSGSETPGSEPATS GSETPGSPAGSPTSTEEG TSTEPSEGSAPGTSTEPS |

TABLE 18-continued

DNA and amino acid sequence of ProTIA constructs of Example 45

| Construct Name | DNA Sequence | Amino Acid Sequence* |
|---|---|---|
| | AGCACTGAGGAGGGCACCTCCACCGAACCATCAGAAGGTAGCGCGCCTGGTACG | EGSAPGGSAPEAGRSANH |
| | TCAACCGAACCTTCCGAGGGCAGCGCACCGGGTGGCTCAGCGCCTGAGGCAGGT | TPAGLTGPATSGSETPGT |
| | CGTTCTGCTAACCATACCCCTGCAGGATTAACCTGGCCCCGCCACCAGCGGGAGC | DIQMTQSPSSLSASVGDR |
| | GAGACCCCCGGGACTGATATTCAGATGACCCAGAGCCCGTCCTCCCTGAGCGCT | VTITCRASQDVNTAVAWY |
| | TCTGTTGGCGACCGCGTGACCATCACCTGCCGTGCTTCCCAGGATGTTAACACC | QQKPGKAPKLLIYSASFL |
| | GCTGTAGCTTGGTATCAACAGAAACCGGGCAAAGCACCGAAACTGCTGATCTAC | YSGVPSRFSGSRSGTDFT |
| | TCTGCTTCCTTTCTGTATAGCGGTGTTCCGTCTCGTTTCAGCGGCTCTCGTAGC | LTISSLQPEDFATYYCQQ |
| | GGTACGGATTTTACTCTGACGATCAGCTCTCTGCAGCCGGAGGACTTCGCTACC | HYTTPPTFGQGTKVEIKG |
| | TACTACTGCCAGCAGCACTACACCACCCCGCCTACCTTTGGTCAGGGCACCAAA | ATPPETGAETESPGETTG |
| | GTGGAAATCAAGGGTGCAACGCCTCCGGAGACTGGTGCTGAAACTGAGTCCCCG | GSAESEPPGEGEVQLVES |
| | GGCGAGACGACCGGTGGCTCTGCTGAATCCGAACCACCGGGCGAAGGCGAGGTC | GGGLVQPGGSLRLSCAAS |
| | CAGCTGGTTGAGTCTGGCGGCGGTCTGGTCCAACCTGGTGGCTCCCTGCGCCTG | GFNIKDTYIHWVRQAPGK |
| | TCTTGCGCAGCGTCCGGCTTTAATATCAAAGATACGTACATTCACTGGGTCCGC | GLEWVARIYPTNGYTRYA |
| | CAGGCACCGGGCAAAGGCCTGGAATGGGTTGCTCGTATCTACCCGACTAACGGT | DSVKGRFTISADTSKNTA |
| | TATACCCGTTATGCAGACAGCGTAAAGGGTCGCTTCACGATCTCCGCGGATACC | YLQMNSLRAEDTAVYYCS |
| | TCCAAAAACACCGCATACCTGCAAATGAACTCTCTGCGTGCGGAAGATACTGCC | RWGGDGFYAMDYWGQGTL |
| | GTGTACTACTGCTCTCGCTGGGGCGGTGACGGTTTCTATGCAATGGACTACTGG | VTVSSGGGGSELVVTQEP |
| | GGTCAAGGTACTCTGGTAACTGTTTCCTCTGGTGGTGGCGGCAGCGAACTGGTC | SLTVSPGGTVTLTCRSST |
| | GTCACGCAGGAGCCGTCCCTTACCGTTTCACCAGGTGGAACAGTGACTCTGACG | GAVTTSNYANWVQQKPGQ |
| | TGTCGCTCCTCCACTGGGGCGGTTACAACTTCCAATTATGCTAATTGGGTCCAG | APRGLIGGTNKRAPGTPA |
| | CAGAAGCCGGGCCAAGCCCCTCGCGGGTTGATTGGCGGCACCAACAAACGTGCT | RFSGSLLGGKAALTLSGV |
| | CCAGGGACACCTGCCCGTTTTTCGGGCTCCTTATTGGGGGGCAAAGCTGCACTG | QPEDEAEYYCALWYSNLW |
| | ACGTTGTCTGGAGTTCAGCCGGAGGATGAGGCAGAGTATTACTGCGCATTGTGG | VFGGGTKLTVLGATPPET |
| | TATTCTAATTTATGGGTTTTGGAGGCGGCACAAAGCTGACCGTCTGGGTGCG | GAETESPGETTGGSAESE |
| | ACCCCGCCGGAAACCGGTGCGGAAACCGAAAGCCCGGGTGAAACCACCGGTGGC | PPGEGEVQLLESGGGLVQ |
| | AGCGCGGAGAGCGAACCGCCGGGTGAAGGTGAGGTTCAGTTGTTGGAAAGCGGG | PGGSLKLSCAASGFTFNT |
| | GGCGGGCTTGTCCAACCTGGAGGTTCATTAAAATTGAGCTGTGCAGCCTCCGGA | YAMNWVRQAPGKGLEWVA |
| | TTCACCTTTAACACGTATGCAATGAACTGGGTCCGTCAAGCGCCCGGTAAGGGG | RIRSKYNNYATYYADSVK |
| | CTGGAGTGGGTAGCTCGCATCCGCTCGAAGTATAATAATTACGCAACCTACTAC | DRFTISRDDSKNTAYLQM |
| | GCAGACAGTGTCAAAGATCGCTTCACTATCTCACGCGACGACAGTAAGAACACG | NNLKTEDTAVYYCVRHGN |
| | GCCTACTTACAGATGAACAATCTTAAAACGGAGGACACCGCTGTCTACTACTGC | FGNSYVSWFAYWGQGTLV |
| | GTGCGCCACGGGAATTTCGGTAACTCTTATGTAAGTTGGTTCGCATATTGGGGA | TVSSGTAEAASASGEAGR |
| | CAAGGTACGTTGGTAACCGTATCCAGCGGGACTGCTGAGGCGGGCTAGCGCCTCC | SANHTPAGLTGPPGSPAG |
| | GGAGAAGCTGGAAGAAGCGCCAATCACACACCAGCTGGACTTACAGGCCCGCCT | SPTSTEEGTSESATPESG |
| | GGTAGCCCCGCGGGGAGCCCTACAAGCACTGAGGAGGGCACATCTGAGTCCGCT | PGTSTEPSEGSAPGSPAG |
| | ACCCCTGAGAGTGGACCCGGGACAAGCACTGAGCCTAGCGAAGGAAGCGCACCA | SPTSTEEGTSTEPSEGSA |
| | GGTTCCCCCGCTGGGAGCCCCACAAGCGAGAGGGGAACTTCTACCGAGTCES | PGTSTEPSEGSAPGTSES |
| | TCTGAGGGCTCAGCCCCTGGAACTAGCACAGAGCCCTCCGAAGGCAGTGCACCG | ATPESGPGSEPATSGSET |
| | GGTACTTCCGAAAGCGCAACTCCGGAATCCGGCCCTGGTTCTGAGCCTGCTACT | PGSEPATSGSETPGSPAG |
| | TCCGGCTCTGAAACTCCAGGTAGCGAGCCAGCGACTTCTGGTTCTGAAACTCCA | SPTSTEEGTSESATPESG |
| | GGTTCACCGGCCGGGTAGCCGAGACGGAGGAAAGTACCTCTGAGTCGGCC | PGTSTEPSEGSAPGTSTE |
| | ACTCCTGAGTCCGGTCCGGGCACGAGCACCGAGCCGAGCGAGGGTTCAGCCCCG | PSEGSAPGSPAGSPTSTE |
| | GGTACCAGCACGGAGCCGTCCGAGGGTAGCGCACCGGGTTCTCCGGCGGGCTCC | EGTSTEPSEGSAPGTSTE |
| | CCTACGTCTACGGAAGAGGGTACGTCCACTGAACCTAGCGAGGGCAGCGCGCCA | PSEGSAPGTSESATPESG |
| | GGCACCAGCACTGAACCTGAACGGAAGGCAGCTGGCACTAGCGAGTCTGCG | PGTSTEPSEGSAPGTSES |
| | ACTCCGGAGAGCGGTCCGGGTACGAGCACGGAACCAAGCGAAGGCAGCGCCCCA | ATPESGPGSEPATSGSET |
| | GGTACCTCTGAATCTGCTACCCCAGAATCGGCCCGGGTTCCGAGCCAGCTACC | PGTSTEPSEGSAPGTSTE |
| | TCTGGTTCTGAAACCCCAGGTACTTCCACTGAACCAAGCGAAGGTAGCGCTCCT | PSEGSAPGTSESATPESG |
| | GGCACTTCTACTGAACCATCCGAAGGTTCCGCTCCTGGTACGTCTGAAGCGCT | PGTSESATPESGPGSPAG |
| | ACCCCTGAAAGCGGCCCAGGCACCTCTGAAAGCGCTACTCCTGAGAGCGGTCCA | SPTSTEEGTSESATPESG |
| | GGCTCTCCAGCAGGTTCTCCAACCTCCACTGAAGAAGGCACCTCTGAGTCTGCT | PGSEPATSGSETPGTSES |
| | ACCCCTGAATCTGGTCCTGGCTCCGAACCTGCTACCTCTGGTTCCGAAACTCCA | ATPESGPGTSTEPSEGSA |
| | GGTACCTCCGGAATCTGCGACTCCGGAATCTGCCCGGGCACGAGCACGGAAGCCG | PGTSTEPSEGSAPGTSTE |
| | TCTGAGGGTAGCGCACCAGGTACCAGCACTGAGCCTTCTGAGGGCTCTGCACCG | PSEGSAPGTSTEPSEGSA |
| | GGTACCTCCACGGAACCTTCGGAAGGTTCTGCGCCGGGTACCTCCACTGAGCCA | PGTSTEPSEGSAPGTSTE |
| | TCCGAGGGTTCAGCACCAGGTACTAGCACGGAACCGTCCGAGGGCTCTGCACCA | PSEGSAPGSPAGSPTSTE |
| | GGTACGAGCACCGAACCGTCGGAGGGTAGCGCTCCAGGTAGCCCAGCGGGCTCT | EGTSTEPSEGSAPGTSES |
| | CCGACAAGCACCGAAGAGGCCACCAGCGAGCCGTCCGAAGGTTCCGCACCA | ATPESGPSEPATSGSET |
| | GGTACAAGCGAGAGCGCGACTCCTGAATCTGGTCCGGGTAGCGAGCCTGCAACC | PGTSESATPESGPGSEPA |
| | AGCGGTTCTGAGACGCCGGGCACTTCCGAATCTGCGACCCCGGAGTCCGGTCCA | TSGSETPGTSESATPESG |
| | GGTTCAGAGCCGGCGACGAGCGGTTCGGAAACGCCGGGTACGTCTGAATCAGCC | PGTSTEPSEGSAPGTSES |
| | ACGCCGGAGTCTGGTCCGGGTACCTCGGAAAGCGCACCA | ATPESGPGSPAGSPTSTE |
| | GGTACTAGCGAGAGCGCAACCCCTGAAAGCGGTCCGGGCAGCCCGGCAGGTTCT | EGSPAGSPTSTEEGSPAG |
| | CCAACCAGCACCGAAGAAGGTTCCCCTGCTGGTAGCCCGACCTACGGAGGAA | SPTSTEEGTSESATPESG |
| | GGTAGCCCTGCAGGTTCCCCAACTTCTACTGAGGAAGGTACTTCTGAGTCCGCT | PGTSTEPSEGSAPGTSES |
| | ACCCCAGAAAGCGGTCCTGGTACCTCCACTGAACCGTCTGAAGGCTCTGCACCA | ATPESGPSEPATSGSET |
| | GGCACTTCTGAGTCTGCTACTCCAGAAAGCGGCCCAGGTTCTGAACCAGCAACT | PGSESATPESGPGSEPA |
| | TCTGGCTCTGAGACTCCAGGCACTTCTGAGTCCGCAACGCCTGAATCCGGTCCT | TSGSETPGTSESATPESG |
| | GGTTCTGAACCAGCTACTTCCGGCAGCGAAACCCCAGGTACCTCTGAGTCTGCG | PGTSTEPSEGSAPGSPAG |
| | ACTCCAGAGTCTGGTCCTGGTACCTCTGAGTGAGCCGAGGGTTCCGCACCA | SPTSTEEGTSESATPESG |
| | GGTTCTCCGGCTGGTAGCCCGACCAGCACGGAGGAGGGTACGTCTGAATCTGCA | PGSEPATSGSETPGTSES |
| | ACGCCGGAATCGGGCCCAGGTTCGGAGCCTGCAACGTCTGGCAGCGAAACCCCG | ATPESGPSEPAGSPTSTE |
| | GGTACCTCCGAATCTGCTACACCGGAAAGCGGTCCTGGCAGCCCTGCTGGTTCT | EGSPAGSPTSTEEGTSTE |
| | CCAACCTCTACCGAGGAGGGTTCACCGGCAGGTAGCCCGACTAGCACTGAAGAA | PSEGSAPGTSESATPESG |
| | GGTACTAGCACGGAGCCGAGCGAGGGTAGTGCTCCGGGTACGAGCGAGAGCGCA | PGTSESATPESGPGTSES |

TABLE 18-continued

DNA and amino acid sequence of ProTIA constructs of Example 45

| Construct Name | DNA Sequence | Amino Acid Sequence* |
|---|---|---|
| | ACGCCAGAGAGCGGTCCAGGCACCAGCGAATCGGCCACCCCTGAGAGCGGCCCA GGTACTTCTGAGAGCGCCACTCCTGAATCCGGCCCTGGTAGCGAGCCGGCAACC TCCGGCTCAGAAACTCCTGGTTCGGAACCAGCGACCAGCGGTTCTGAAACTCCG GGTAGCCCGGCAGGCAGCCCAACGAGCACCGAAGAGGGTACCAGCACGGAACCG AGCGAGGGTTCTGCCCCGGGTACTTCCACCGAACCATCGGAGGGCTCTGCACCT GGTAGCGAACCTGCGACGTCTGGTTCTGAAACGCGGGTACCAGCGAAAGCGCT ACCCCAGAATCCGGTCCGGGCACTAGCACCGAGCCATCGGAGGGCGCCGCAGAA CCAGAGGCG (SEQ ID NO.: 1010) | ATPESGPGSEPATSGSET PGSEPATSGSETPGSPAG SPTSTEEGTSTEPSEGSA PGTSTEPSEGSAPGSEPA TSGSETPGTSESATPESG PGTSTEPSEGAAEPEA (SEQ ID NO.: 1020) |
| AC1948 | ATGAAGAAAAACATCGCTTTTCTTCTTGCATCTATGTTCGTTTTTTCTATTGCT ACAAACGCGTACGCTTCCCCAGCAGGCAGCCCGACCAGCACCGAGGAGGGTACG AGCGAGTCGGCTACTCCAGAGAGCGGTCCGGGTACCTCTACGGAACCGTCCGAA GGTAGCGCTCCAGGCACGTCTGAAAGCGCGACGCCGGAAAGCGGTCCAGGCAGC GAGCCGGCGACCTCCGGTAGCGAAACGCCTGGTACCTCGGAGTCAGCGACTCCG GAAAGCGGTCCGGGTAGCGAACCTGCAACGAGCGGTAGCGAGACTCCAGGCACT AGCGAATCCGCAACTCCGGAGTCGGGTCCGGGCACCTCTACGGAGCCTAGCGAG GGCTCAGCACCAGGTAGCCCTGCAGGTTCCCGACGTCAACCGAGGAAGGTACA AGCGAAAGCGCCACCCCTGAGTCGGGCCCTGGCAGCGAACCGGCAACTAGCGGC AGCGAGACTCCGGGTACCAGCGAATCTGCTACGCCAGAGAGCGGCCCAGGTTCG CCAGCGGGTTCGCCGACTAGCACGGAGGAGGGCAGCCCAGCGGGTAGCCCGACC AGCACTGAGGAGGGTACGTCCACCGAACCGAGCGAAGGTAGCGCACCAGGTACC TCCGAGTCTGCCACCCCTGAATCCGGTCCAGGTACCAGCGAATCAGCCACCCCG GAGTCGGGTCCAGGTACGAGCGAATCTGCTACCCCGGAATCCGGCCCAGGCAGC GAACCTGCTACTAGCGGCAGCGAAACGCCGGGCAGCGAACCTGCCACGTCAGGC AGCGAGACGCCGGGTTCCCCTGCAGGCTCCCGACCAGCACTGAGGAGGCACC TCCACCGAACCATCAGAAGGTAGCGCGCCTGGACGTCAACCGAACCTTCCGAG GGCAGCGCACCGGGTGGCTCAGCGCCTGAGGCAGGTCGTTCTGCTAACCATACC CCAGCGGGGCTGACTGGGCCTGCTACCTCAGGCTCCGAAACCCCGGGCACCGAT ATCCAGATGACCCAGAGCCCTTCTTCCCTGTCCGCATCCGTCGGCGATCGTGTC ACGATTACCTGTCGCAGCACTAAGAGCCTGCTGCACTCAAACGGTATCACGTAC CTGTACTGGTACCAGCAGAAGCCGGGCAAAGCGCCGAAGCTGCTGATTTATCAG ATGAGCAACCTGGCATCGGGCGTGCCGAGCCGTTTCAGCAGCAGCGGTAGCGGT ACCGACTTCACGCTGACCATCAGCTCGTTGCAGCCAGAGGACTTTGCGACGTAC TATTGTGCGCAAAACTTGGAAATTCCGCGCACCTTCGGCCAGGGTACGAAAGTT GAGATTAAAGGTGCCACCCCACCGGAGACTGGTGCAGAAACCGAGTCTCCGGGC GAAACCACGGCGGTGAGCGCGAGAGCGAACCGCCTGGTGAGGGTCAAGTTCAA TTGGTTCAGAGCGGTCCGGGTCTGGTTCAACCGGGCGGCAGCGTGCGCATTTCT TGTGCGGCCAGCGGTTACACCTTTACGAACTACGGTATGAATTGGGTGAAACAA GCTCCGGGCAAAGGTCTGGAGTGGATGGGTTGGATCAATACCTATACCGGTGAA TCCACTTACGCGGATTCCTTTAAGGGCCGTTTCACCTTCAGCCTGGACACAAGC GCGAGCGCTGCATATCTGCAAATCAATAGCCTGCGTGCCGAAGATACCGCGGTG TACTATTGCGCGCGTTTTGCAATCAAGGGCGACTATTGGGTCAAGGCACGCTG CTGACCGTGAGCAGCGGTGGTGGCGGCAGCGATATCCAGATGACCCAAAGCCCG AGCAGCCTGCCGGCGAGCCTGGGTGACCGTGACATCACCAATCTGCCAGGCGAGC CAAGATATTAGCAACTACCTGAACTGGTATCAGCAAAAGCCGGGCAAAGCGCCG AAGCTGCTGATTTACTATACCAACAAGCTGGCGGATGGTGTTCCGAGCCGTTTC AGCGGTAGCGGCAGCGGTCGTGACAGCAGCTTTACCATCAGCAGCCTGGAGAGC GAAGATATTGGTAGCTACTATTGCCAACAATACTACAACTATCCGTGGACCTTC GGTCCGGGCACCAAACTGGAAATCAAAGGTGCGACCCCCGCCGGAAACCGGTGCG GAAACCGAAAGCCCGGGTGAAACCACCGGTGGCAGCGCGGAGAGCGAACCGCCG GGTGAAGGTGAAGTGCAACTGGTGGAGAGCGGTGGTGGTCTGGTGCAACCGGGC AAGAGCCTGAAACTGAGCTGCGAAGCGAGCGGCTTTACCTTTAGCGGTTATGGT ATGCATTGGGTGCGTCAGGCGCCGGGTCGTGGCCTGGAGAGCGTTGCGTACATC ACCAGCAGCAGCATCAACATTAAATATGCGGACGCGGTGAAGGGCCGTTTCACC GTTAGCCGTGATAACGCGAAAAACCTGCTGTTTCTGCAGATGAACATTCTGAAG AGCGAGGACACCGCGATGTACTATTGCGCGCGTTTCGACTGGGATAAAAACTAT TGGGGTCAAGGCACCATGGTGACCGTTAGCAGCGGCACCGCCGAAGCAGCTAGC GGCGAAGCACACCCTGCTGGTCTTCTGCTAACCATACCCCAGCGGGCTGACTGG CCTCAGGTAGCCCAGCTGGTAGCCCAACCAGTACTGAAGAAGGTACCTCTGAA TCCGCTACTCCAGAATCCGGTCCTGGTACTAGCACTGAGCCAAGCGAAGGTTCT GCTCCAGGCTCCCCGGCAGGTAGCCTCTACCGAAGCAGCACTAGCACC GAACCATCTGAGGGTTCCGCTCCTGGCACCTCCACTGAACCGTCCGAAGGCAGT GCTCCGGGTACTTCCGAAAGCGCAACTCCGGAATCCGGCCCTGGTTCTGAGCCT GCTACTTCCGGCTCTGAAACTCCAGGTAGCGAGCCAGCGACTTCTGGTTCTGAA ACTCCAGGTTCACCGGCGGGTAGCCCAGCACGGAGGAAGGTACCTCTGAG TCGGCCACTCCTGAGTCCGGTCCGGGCACGAGCACCGAGCCGAGCGAGGGTTCA GCCCCGGGTACCAGCACGGAGCCGTCCGAGGGTAGCGCACCGGGTTCTCCGGCG GGCTCCCCTACGTCTACGGAAGAGGGTACGTCCACTGAACCTAGCGAGGGCAGC GCGCCAGGCACCAGCACTGAACCGAGCGAAGGCAGCGCCACCTGGCACGAGC TCTGCGACTCCGGAGAGCGGTCCGGGTACGAGCACGAACCAAGCGAAGGCAGC GCCCCAGGTACCTCTGAATCTGCTACCCCAGAATCTGGCCCGGGTTCCGAGCCA GCTACCTCTGGTTCTGAAACCCAGGTACTTCCACTGAACCAAGCGAAGGTAGC GCTCCTGGCACTTCTACTGAACCATCCGAAGGTTCCGCTCCTGGTACGTCTGAA AGCGCTACCCCTGAAAGCGGCCCAGGCACCCTCTGAAAGCGCTACTCCTGAGAGC | SPAGSPTSTEEGTSESAT PESGPGTSTEPSEGSAPG TSESATPESGPGSEPATS GSETPGTSESATPESGPG SEPATSGSETPGTSESAT PESGPGTSTEPSEGSAPG SPAGSPTSTEEGTSESAT PESGPGSEPATSGSETPG TSESATPESGPGSPAGSP TSTEEGSPAGSPTSTEEG TSTEPSEGSAPGTSESAT PESGPGTSESATPESGPG TSESATPESGPGSEPATS GSETPGSEPATSGSETPG SPAGSPTSTEEGTSTEPS EGSAPGTSTEPSEGSAPG GSAPEAGRSANHTPAGLT GPATSGSETPGTDIQMTQ SPSSLSASVGDRVTITCR STKSLLHSNGITYLYWYQ QKPGKAPKLLIYQMSNLA SGVPSRFSSSGSGTDFTL TISSLQPEDFATYYCAQN LEIPRTFGQGTKVEIKGA TPPETGAETESPGETTGG SAESEPPGEGQVQLVQSG PGLVQPGGSVRISCAASG YTFTNYGMNWVKQAPGKG LEWMGWINTYTGESTYAD SFKGRFTFSLDTSASAAY LQINSLRAEDTAVYYCAR FAIKGDYWGQGTLLTVSS GGGGSDIQMTQSPSSLPA SLGDRVTINCQASQDISN YLNWYQQKPGKAPKLLTY YTNKLADGVPSRFSGSGS GRDSSFTISSLESEDIGS YYCQQYYNYPWTFGPGTK LEIKGATPPETGAETESP GETTGGSAESEPPGEGEV QLVESGGGLVQPGKSLKL SCEASGFTFSGYGMHWVR QAPGRGLESVAYITSSSI NIKYADAVKGRFTVSRDN AKNLLFLQMNILKSEDTA MYYCARFDWDKNYWGQGT MVTVSSGTAEAASASGEA GRSANHTPAGLTGPPGSP AGSPTSTEEGTSESATPE SGPGTSTEPSEGSAPGSP AGSPTSTEEGTSTEPSEG SAPGTSTEPSEGSAPGTS ESATPESGPGSEPATSGS ETPGSEPATSGSETPGSP AGSPTSTEEGTSESATPE SGPGTSTEPSEGSAPGTS TEPSEGSAPGSPAGSPTS TEEGTSTEPSEGSAPGTS TEPSEGSAPGTSESATPE SGPGTSTEPSEGSAPGTS ESATPESGPGSEPATSGS ETPGTSTEPSEGSAPGTS TEPSEGSAPGTSESATPE SGPGTSESATPESGPGSP AGSPTSTEEGTSESATPE |

TABLE 18-continued

DNA and amino acid sequence of ProTIA constructs of Example 45

| Construct Name | DNA Sequence | Amino Acid Sequence* |
|---|---|---|
| | GGTCCAGGCTCTCCAGCAGGTTCTCCAACCTCCACTGAAGAAGGCACCTCTGAG<br>TCTGCTACCCCTGAATCTGGTCCTGGCTCCGAACCTGCTACCTCTGGTTCCGAA<br>ACTCCAGGTACCTCGGAATCTGCGACTCCGGAATCTGGCCCGGGCACGAGCACG<br>GAGCCGTCTGAGGGTAGCGCACCAGGTACCAGCACTGAGCCTTCTGAGGGCTCT<br>GCACCGGGTACCTCCACGGAACCTTCGGAAGGTTCTGCGCCGGGTACCTCCACT<br>GAGCCATCCGAGGGTTCAGCACCAGGTACTAGCACGGAACCGTCCGAGGGCTCT<br>GCACCAGGTACGAGCACCGAACCGTCGGAGGGTAGCGCTCCAGGTAGCCCAGCG<br>GGCTCTCCGACAAGCACCGAAGAAGGCACCAGCACCGAGCCGTCCGAAGGTTCC<br>GCACCAGGTACAAGCGAGAGCGCGACTCCTGAATCTGGTCCGGGTAGCGAGCCT<br>GCAACCAGCGGTTCTGAGACGCCGGGCACTTCCGAATCTGCGACCCCGGAGTCC<br>GGTCCAGGTTCAGAGCCGGCGACGAGCGGTTCGGAAACGCCGGGTACGTCTGAA<br>TCAGCCACGCCGGAGTCTGGTCCGGGTACCTCGACCGAACCAAGCGAAGGTTCG<br>GCACCGGGTACTAGCGAGAGCGCAACCCCTGAAAGCGGTCCGGGCAGCCCGGCA<br>GGTTCTCCAACCAGCACCGAAGAAGGTTCCCCTGCTGGTAGCCCGACCTCTACG<br>GAGGAAGGTAGCCCTGCAGGTTCCCCAACTTCTACTGAGGAAGGTACTTCTGAG<br>TCCGCTACCCCAGAAAGCGGTCCTGGTACCTCTGAGCCTGCAGGAGGGTTCC<br>GCACCAGGCACTTCTGAGTCTGCTACTCCAGAAAGCGGCCCAGGTTCTGAACCA<br>GCAACTTCTGGCTCTGAGACTCCAGGCACTTCTGAGTCCGCAACGCCTGAATCC<br>GGTCCTGGTTCTGAACCAGCTACTTCCGGCAGCGAAACCCCAGGTACCTCTGAG<br>TCTGCGACTCCAGAGTCTGGTCCTGGCACTTCCACTGAGCCTGACGAGGGTTCC<br>GCACCAGGTTCTCCGGCTGGTAGCCCGACCAGCACGGAGGAGGGTACGTCTGAA<br>TCTGCAACGCCGGAATCGGGCCCAGGTTCGGAGCTGCAACGTCTGGCAGCGAA<br>ACCCCGGGTACCTCCGAATCTGCTACACCGGAAAGCGGTCCTGGCAGCCCTGCT<br>GGTTCTCCAACCTCTACCGAGGAGGGTTCACCGGCAGGTAGCCCGACTAGCACT<br>GAAGAAGGTACTAGCACGGAGCCGAGCGAGGGTAGTGCTCCGGGTACGAGCGAG<br>AGCGCAACGCCAGAGAGCGGTCCAGGCACCAGCGAATCGGCCACCCCTGAGAGC<br>GGCCCAGGTACTTCTGAGAGCGCCACTCCTGAATCCGGCCCTGGTAGCGAGCCG<br>GCAACCTCCGGCTCAGAAACTCCTGGTTCGGAACCGCGACCAGCGGTTCTGAA<br>ACTCCGGGTAGCCCGGCAGGCAGCCCAACGAGCACCGAAGAGGGTACCAGCACG<br>GAACCGAGCGAGGGTTCTGCCCCGGGTACTTCCACCGAACCATCGGAGGGCTCT<br>GCACCTGGTAGCGAACCTGCGACGTCTGGTTCTGAAACGCCGGGTACCAGCGAA<br>AGCGCTACCCCAGAATCCGGTCCGGGCACTAGCACCGAGCCATCGGAGGGCTCC<br>GCACCAGGTCACCATCACCATCAC<br>(SEQ ID NO.: 1011) | SGPGSEPATSGSETPGTS<br>ESATPESGPGTSTEPSEG<br>SAPGTSTEPSEGSAPGTS<br>TEPSEGSAPGTSTEPSEG<br>SAPGTSTEPSEGSAPGTS<br>TEPSEGSAPGSPAGSPTS<br>TEEGTSTEPSEGSAPGTS<br>ESATPESGSEPATSGS<br>ETPGTSESATPESGPGSE<br>PATSGSETPGTSESATPE<br>SGPGTSTEPSEGSAPGTS<br>ESATPESGPGSPAGSPTS<br>TEEGSPAGSPTSTEEGSP<br>AGSPTSTEEGTSESATPE<br>SGPGTSTEPSEGSAPGTS<br>ESATPESGPGSEPATSGS<br>ETPGTSESATPESGPGSE<br>PATSGSETPGTSESATPE<br>SGPGTSTEPSEGSAPGSP<br>AGSPTSTEEGTSESATPE<br>SGPGSEPATSGSETPGTS<br>ESATPESGPSPAGSPTS<br>TEEGSPAGSPTSTEEGTS<br>TEPSEGSAPGTSESATPE<br>SGPGTSESATPESGPGTS<br>ESATPESGPGSEPATSGS<br>ETPGSEPATSGSETPGSP<br>AGSPTSTEEGTSTEPSEG<br>SAPGTSTEPSEGSAPGSE<br>PATSGSETPGTSESATPE<br>SGPGTSTEPSEGSAPGHH<br>HHHH<br>(SEQ ID NO.: 1021) |
| AC1952 | ATGAAGAAAAACATCGCTTTTCTTCTTGCATCTATGTTCGTTTTTTCTATTGCT<br>ACAAACGCGTACGCTTCCCCAGCAGGCAGCCCGACCAGCACCGAGGAGGGTACG<br>AGCGAGTCGGCTACTCCAGAGAGCGGTCCGGGTACCTCTACGGAACCGTCCGAA<br>GGTAGCGCTCCAGGCACGTCTGAAAGCGCGACGCCGGAAAGCGGTCCAGGCAGC<br>GAGCCGGCGACCTCCGGTAGCGAAACGCCTGGTACCTCGGAGTCAGCGACTCCG<br>GAAAGCGGTCCGGGTAGCGAACCTGCAACGAGCGGTAGCGAGACTCCAGGCACT<br>AGCGAATCCGCAACTCCGGAGTCGGGTCCGGGCACCTCTACGGAGCCTAGCGAG<br>GGCTCAGCACCAGGTAGCCCTGCAGGTTCCCCGACGTCAACCGAGGAAGGTACA<br>AGCGAAAGCGCCACCCCTGAGTCGGGCCCTGGCAGCGAACCGGCAACTAGCGGC<br>AGCGAGATCTCCAGGTACCGACGAGTCTGCTACGCCAGAGAGCGGCCCAGGTTCG<br>CCAGCGGGTTCGCCGACTAGCACGGAGGAGGGCAGCCCAGCGGGTAGCCCGACC<br>AGCACTGAGGAGGGTACGTCCACCGAACCGAGCGAAGGTAGCGCACCAGGTACC<br>TCCGAGTCTGCCACCCCTGAATCCGGTCCAGGTACCAGCGAATCAGCCACCCCG<br>GAGTCGGGTCCAGGTACGAGCGAATCTGCTACCCCGGAATCCGGCCCAGGCAGC<br>GAACCTGCTACTAGCGGCAGCGAAACGCCGGGCAGCGAACCTGCCACGTCAGGC<br>AGCGAGACGCCGGGTTCCCCTGCAGGCTCCCCGACCAGCACTGAGGAGGCACC<br>TCCACCGAACCATCAGAAGGTAGCGCGCCTGGTACGTCAACCGAACCTTCCGAG<br>GGCAGCGCACCGGGTGGCTCAGCGCCTGAGGCAGGTCGTTCTGCTAACCATACC<br>CCAGCGGGGCTGACTGGGCCTGCTACCTCAGGCTCCGAAACCCCGGGCACCGAT<br>ATCCAGATGACCCAGAGCCCTTCTTCCCTGTCCGCATCCGTCGGCGATCGTGTC<br>ACGATTACCTGTCGCAGCACTAAGAGCCTGCTGCACTCAAACGGTATCACGTAC<br>CTGTACTGGTACCAGCAGAAGCCGGGCAAAGCGCCGAAGCTGCTGATTTATCAG<br>ATGAGCAACCTGGCATCGGGCGTGCCGAGCCGTTTCAGCAGCAGCGGTAGCGGT<br>ACCGACTTCACGCTGACCATCAGCTCGTTGCAGCCAGAGGACTTTGCGACGTAC<br>TATTGTGCGCAAAACTTGGAAATTCCGCGCACCTTCGGCCAGGGTACGAAAGTT<br>GAGATTAAAGGTGCCACCCCACCGGAGACTGGTGCAGAAACCGAGTCTCCGGGC<br>GAAACCACGGGCGGTAGCGCGGAGAGCGAACCGCCTGGTGAGGGCCAAGTTCAA<br>TTGGTTCAGAGCGGTCCGGGTCTGGTTCAACCGGGCGGCAGCGTGCGCATTTCT<br>TGTGCGGCCAGCGGTTACACCTTTACGAACTACGGTATGAATTGGGTGAAACAA<br>GCTCCGGGCAAAGGTCTGGAGTGGATGGGTTGGATCAATACCTATACCGGTGAA<br>TCCACTTACGCGGATTCCTTTAAGGGCCGTTTCACCTTCAGCCTTGACACGGCAT<br>CGCAGCGCTGCATATCTGCAAATCAATAGCCTGCGTGCCGAAGATACCGCGGTG<br>TACTATTGCGCGCGTTTTGCAATCAAGGGCGACTATTGGGTCAAGGCACGCTG<br>CTGACCGTGAGCAGCGGTGGTGGCGGCAGCGAGTTAGTTGTGACCCAAGAGCCG<br>AGCCTGACCGTTAGCCCGGGTGGTACGGTCACCCTGACGTGCCGTAGCAGCACC<br>GGTGCGGTCACGACCAGCAACTATGCCAATTGGGTCCAGCAGAAACCGGGTCAA<br>GCACCGCGTGGCCTGATCGGCGGCACCAATAAACGTGCCCCGGGTACTCCTGCG<br>CGTTTCTCCGGTAGCCTGCTGGGCGGAAAGCCGCTCTGACCCTGAGCGGTGTC<br>CAGCCGGAAGATGAAGCGGAGTACTACTGCGCGCTGTGGTATTCCAATCTGTGG<br>GTTTTTGGCGGCGGTACCAAGCTGACCGTATTGGGTGCTACGCCACCGGAGACT | SPAGSPTSTEEGTSESAT<br>PESGPGTSTEPSEGSAPG<br>TSESATPESGPGSEPATS<br>GSETPGTSESATPESGPG<br>SEPATSGSETPGTSESAT<br>PESGPGTSTEPSEGSAPG<br>SPAGSPTSTEEGTSESAT<br>PESGPGSEPATSGSETPG<br>TSESATPESGPGSPAGSP<br>TSTEEGSPAGSPTSTEEG<br>TSTEPSEGSAPGTSESAT<br>PESGPGTSESATPESGPG<br>TSESATPESGPGSEPATS<br>GSETPGSEPATSGSETPG<br>SPAGSPTSTEEGTSTEPS<br>EGSAPGTSTEPSEGSAPG<br>GSAPEAGRSANHTPAGLT<br>GPATSGSETPGTDIQMTQ<br>SPSSLSASVGDRVTITCR<br>STKSLLHSNGITYLYWYQ<br>QKPGKAPKLLIYQMSNLA<br>SGVPSRFSSSGSGTDFTL<br>TISSLQPEDFATYYCAQN<br>LEIPRTFGQGTKVEIKGA<br>TPPETGAETESPGETTGG<br>SAESEPPGEGQVQLVQSG<br>PGLVQPGGSVRISCAASG<br>YTFTNYGMNWVKQAPGKG<br>LEWMGWINTYTGESTYAD<br>SFKGRFTFSLDTSASAAY<br>LQINSLRAEDTAVYYCAR<br>FAIKGDYWGQGTLLTVSS<br>GGGGSELVVTQEPSLTVS<br>PGGTVTLTCRSSTGAVTT<br>SNYANWVQQKPGQAPRGL<br>IGGTNKRAPGTPARFSGS<br>LLGGKAALTLSGVQPEDE<br>AEYYCALWYSNLWVFGGG<br>TKLTVLGATPPETGAETE<br>SPGETTGGSAESEPPGEG |

TABLE 18-continued

DNA and amino acid sequence of ProTIA constructs of Example 45

| Construct Name | DNA Sequence | Amino Acid Sequence* |
|---|---|---|
|  | GGCGCAGAAACGGAAAGCCCGGGTGAGACTACGGGTGGCTCTGCGGAGAGCGAA<br>CCTCCGGGTGAGGGTGAGGTCCAACTGCTGGAGTCTGGTGGTGGCCTGGTTCAA<br>CCGGGTGGCTCGTTGAAGCTGAGCTGTGCAGCTAGCGGCTTTACCTTCAACACC<br>TATGCGATGAATTGGGTTCGTCAGGCACCGGGTAAGGGCCTGGAATGGGTGGCG<br>CGTATCCGCTCCAAGTACAACAACTACGCGACCTACTACGCGGATAGCGTTAAA<br>GACCGCTTCACGATTAGCCGTGACGATTCCAAGAATACGGCATATCTGCAAATG<br>AACAATCTGAAAACCGAAGATACCGCGGTGTATTACTGTGTGCGCCACGGCAAT<br>TTCGGCAACAGCTACGTGAGCTGGTTTGCATATTGGGGTCAGGGCACCCTGGTT<br>ACGGTGAGCTCCGGCACCGCCGAAGCAGCTAGCGCCTCTGGCGAGGCAGGTCGT<br>TCTGCTAACCATACCCCAGCGGGGCTGACTGGGCCTCCAGGTAGCCCAGCTGGT<br>AGCCCAACCTCTACCGAAGAAGGTACCTCTGAATCCGCTACTCCAGAATCCGGT<br>CCTGGTACTAGCACTGAGCCAAGCGAAGGTTCTGCTCCAGGTTCCCCGGCAGGT<br>AGCCCTACCTCTACCGAAGAGGGCACTAGCACCGAACCATCTGAGGGTTCCGCT<br>CCTGGCACCTCCACTGAACCGTCCGAAGGCAGTGCTCCGGGTACTTCCGAAAGC<br>GCAACTCCGGAATCCGGCCCTGGTTCTGAGCCTGCTACTTCCGGCTCTGAAACT<br>CCAGGTAGCGAGCCAGCGACTTCTGGTTCTGAAACTTCCAGGTTCACCGGCGGT<br>AGCCCGACGAGCACGGAGGAAGGTACCTCTGAGTCGGCCACTCCTGAGTCCGGT<br>CCGGGCACGAGCACCGAGCCGAGCGAGGGTTCAGCCCCGGGTACCAGCACGGAG<br>CCGTCCGAGGGTAGCGCACCGGGTTCTCCGGCGGGCTCCCCTACGTCTACGAA<br>GAGGGTACGTCCACTGAACCTAGCGAGGGCAGCGCGCACGGCACCACTGAA<br>CCGAGCGAAGGCAGCGCACCTGGCACTAGCGAGTCTGCGACTCCGGAGAGCGGT<br>CCGGGTACGAGCACGGAACAAGCGAAGGCAGCGCCCCAGGTACCTCTGAATCT<br>GCTACCCCAGAATCTGGCCCGGGTTCCGAGCCAGCTACCTCTGGTTCTGAAACC<br>CCAGGTACTTCCACTGAACCAAGCGAAGGTAGCGCTCCTGGCACTTCTACTGAA<br>CCATCCGAAGGTTCCGCTCCTGGTACGTCTGAAAGCGCTACCCCTGAAAGCGGC<br>CCAGGCACCTCTGAAAGCGCTACTCCTGAGAGCGGTCCAGGCTCTCCAGCAGGT<br>TCTCCAACCTCCACTGAAGAAGGCACCTCTGAGTCTGCTACCCCTGAATCTGGT<br>CCTGGCTCCGAACCTGCTACCTCTGGTTCCGAAACTCCAGGTACCTCGGAATCT<br>GCGACTCCGGAATCTGGCCCGGGCACGAGCACGGAGCCGTCTGAGGGTAGCGCA<br>CCAGGTACCAGCACTGAGCCTTCTGAGGGCTCTGCACCGGGTACCTCCACGGAA<br>CCTTCGGAAGGTTCTGCGCCGGGTACCTCCACTGAGCCATCCGAGGGTTCAGCA<br>CCAGGTACTACGACGGAACCGTCCGAGGGCTCTGCACCAGGTACGAGCACCGAA<br>CCGTCGGAGGGTAGCGCTCCAGGTAGCCCAGCGGGCTCTCCGACAAGCACCGAA<br>GAAGGCACCAGCACCGAGCCGTCCGAAGGTTCCGCACCAGGTACAAGCGAGAGC<br>GCGACTCCTGAATCTGGTCCGGGTAGCGAGCCTGCAACCAGCGGTTCTGAGACG<br>CCGGGCACTTCCGAATCTGCGACCCCGGAGTCCGGTCCAGGTTCAGAGCCGGCG<br>ACGAGCGGTTCGGAAACGCCGGGTACGTCTAATCAGCCACGCCGGAGTCTGGT<br>CCGGGTACCTCGACCGAACCAAGCGAAGGTTCGGCACCGGGTACTAGCGAGAGC<br>GCAACCCCTGAAAGCGGTCCGGGCAGCCCGGCAGGTTCTCCAACCAGCACCGAA<br>GAAGGTTCCCCTGCTGGTAGCCCGACCTCTACGGAGGAAGGTAGCCCTGCAGGT<br>TCCCCAACTTCTACTGAGGAAGGTACTTCTGAGTCCGCTACCCCAGAAAGCGGT<br>CCTGGTACCTCCACTGAACCGTCTGAAGGCTCTGCACCAGGCACTTCTGAGTCT<br>GCTACTCCAGAAAGCGGCCCAGGTTCTGAACCAGCAACTTCTGGCTCTGAGACT<br>CCAGGCACTTCTGAGTCCGAACGCCTGAATCCGGTCCTGGTTCTGAACCAGCT<br>ACTTCCGGCAGCGAAACCCCAGGTACCTCTGAGTCTGCGACTCCAGGAGTCTGGT<br>CCTGGTACTTCCACTGAGCCTAGCGAGGGTTCCGCACCAGGTTCTCCGGCTGGT<br>AGCCCGACCAGCACGGAGGAGGGTACGTCTAATCTGCAACGCCGGAATCGGC<br>CCAGGTTCGGAGCCTGCAACGTCTGGCAGCGAAACCCCGGGTACCTCCGAATCT<br>GCTACACCGGAAAGCGGTCTGGCAGCCCTGCTGGTTCTCCAACCTCTACCGAG<br>GAGGGTTCACCGGCAGGTAGCCCGACTAGCACTGAAGAAGGTACTAGCACGGAG<br>CCGAGCGAGGGTAGTGCTCCGGGTACGAGCGAGAGCGCAACGCCAGAGAGCGGT<br>CCAGGCACCAGCGAATCGGCCACCCCTGAGAGCGGCCCAGGTACTTCTGAGAGC<br>GCCACTCCTGAATCCGGCCCTGGTAGCGAGGCCCAACCTCCGGCTCAGAAACT<br>CCTGGTTCGGAACCAGCGACCAGCGGTTCTGAAACTCCGGGTAGCCCGGCAGGC<br>AGCCCAACGAGCACGAAGAGGGTACCAGCACGGAACCGAGCGAGGGTTCTGCC<br>CCGGGTACTTCCACCGAACCATCGGAGGGCTCTGCACCTGGTAGCGAACCTGCG<br>ACGTCTGGTTCTGAAACGCCGGGTACCAGCGAAAGCGCTACCCCAGAATCCGGT<br>CCGGGCACTAGCACCGAGCCATCGGAGGGCTCCGCACCAGGTCACCATCATCAC<br>CATCAC<br>(SEQ ID NO.: 1012) | EVQLLESGGGLVQPGGSL<br>KLSCAASGFTFNTYAMNW<br>VRQAPGKGLEWVARIRSK<br>YNNYATYYADSVKDRFTI<br>SRDDSKNTAYLQMNNLKT<br>EDTAVYYCVRHGNFGNSY<br>VSWFAYWGQGTLVTVSSG<br>TAEAASASGEAGRSANHT<br>PAGLTGPPGSPAGSPTST<br>EEGTSESATPESGPGTST<br>EPSEGSAPGSPAGSPTST<br>EEGTSTEPSEGSAPGTST<br>EPSEGSAPGTSESATPES<br>GPGSEPATSGSETPGSEP<br>ATSGSETPGSPAGSPTST<br>EEGTSESATPESGPGTST<br>EPSEGSAPGTSTEPSEGS<br>APGSPAGSPTSTEEGTST<br>EPSEGSAPGTSTEPSEGS<br>APGTSESATPESGPGTSE<br>EPSEGSAPGTSESATPES<br>GPGSEPATSGSETPGTST<br>EPSEGSAPGTSTEPSEGS<br>APGTSESATPESGPGTSE<br>SATPESGPGSPAGSPTST<br>EEGTSESATPESGPGSEP<br>ATSGSETPGTSESATPES<br>GPGTSTEPSEGSAPGTST<br>EPSEGSAPGTSTEPSEGS<br>APGTSTEPSEGSAPGTST<br>EPSEGSAPGTSTEPSEGS<br>APGSPAGSPTSTEEGTST<br>EPSEGSAPGTSESATPES<br>GPGSEPATSGSETPGTSE<br>SATPESGPGSEPATSGSE<br>TPGTSESATPESGPGTST<br>EPSEGSAPGTSESATPES<br>GPGSPAGSPTSTEEGSPA<br>GSPTSTEEGSPAGSPTST<br>EEGTSESATPESGPGTST<br>EPSEGSAPGTSESATPES<br>GPGSEPATSGSETPGTSE<br>SATPESGPGSEPATSGSE<br>TPGTSESATPESGPGTST<br>EPSEGSAPGSPAGSPTST<br>EEGTSESATPESGPGSEP<br>ATSGSETPGTSESATPES<br>GPGSPAGSPTSTEEGSPA<br>GSPTSTEEGTSTEPSEGS<br>APGTSESATPESGPGTSE<br>SATPESGPGTSESATPES<br>GPGSEPATSGSETPGSEP<br>ATSGSETPGSPAGSPTST<br>EEGTSTEPSEGSAPGTST<br>EPSEGSAPGSEPATSGSE<br>TPGTSESATPESGPGTST<br>EPSEGSAPGHHHHHH<br>(SEQ ID NO.: 1022) |
| AC2084 | ATGAAGAAAAACATCGCTTTTCTTCTTGCATCTATGTTCGTTTTTTCTATTGCT<br>ACAAACGCGTACGCTCACCATCATCACCATCACTCCCCAGCAGGCAGCCCGACC<br>AGCACCGAGGAGGGTACGAGCGAGTCGGCTACTCCAGAGAGCGGTCCGGGTACC<br>TCTACGGAACCGTCCGAAGGTAGCGCTCCAGGCACGTCTGAAAGCGCGACGCCG<br>GAAAGCGGTCCAGGCAGCGAGCCGGCAGCCTCCGGTAGCGAAAGCGCTGGTACC<br>TCGGAGTCAGCGACTCCGGAAAGCGGTCCGGGTAGCGAACCTGCAACGAGCGGT<br>AGCGAGACTCCAGGCACTAGCGAATCGCAACTCCGGAGTCGGGTCCGGGCACC<br>TCTACGGAGCCTAGCGAGGGCTCAGCACCAGGTAGCCCTGCAGGTTCCCCGACG<br>TCAACCGAGGAAGGTACAAGCGAAAGCGCCACCCCTGAGTCTGGGCCCTGGT<br>GAACCGGCAACTAGCGGCAGCGAGACTCCGGGTACCAGCGAGTCTGCTACGCCA<br>GAGAGCGGCCCAGGTTCGCCAGCGGGTTCGCCGACTAGCACGGAGGAGGGCAGC<br>CCAGCGGGTAGCCCGACCAGCACTGAGGAGGGTACGTCCACCGAACCGAGCGAA<br>GGTAGCGCACCAGGTACCTCCGAGTCTGCCACCCCTGAATCCGGTCCAGGTACC<br>AGCGAATCAGCCACCCCGGAGTCGGGTCCAGGTACGAGCGAATCTGCTACCCCG | HHHHHHSPAGSPTSTEEG<br>TSESATPESGPGTSTEPS<br>EGSAPGTSESATPESGPG<br>SEPATSGSETPGTSESAT<br>PESGPGSEPATSGSETPG<br>TSESATPESGPGTSTEPS<br>EGSAPGSPAGSPTSTEEG<br>TSESATPESGPGSEPATS<br>GSETPGTSESATPESGPG<br>SPAGSPTSTEEGSPAGSP<br>TSTEEGTSTEPSEGSAPG<br>TSESATPESGPGTSESAT<br>PESGPGTSESATPESGPG<br>SEPATSGSETPGSEPATS |

TABLE 18-continued

DNA and amino acid sequence of ProTIA constructs of Example 45

| Construct Name | DNA Sequence | Amino Acid Sequence* |
|---|---|---|
| | GAATCCGGCCCAGGCAGCGAACCTGCTACTAGCGGCAGCGAAACGCCGGGCAGC | GSETPGSPAGSPTSTEEG |
| | GAACCTGCCACGTCAGGCAGCGAGACGCCGGGTTCCCCTGCAGGCTCCCCGACC | TSTEPSEGSAPGTSTEPS |
| | AGCACTGAGGAGGGCACCTCCACCGAACCATCAGAAGGTAGCGCGCCTGGTACG | EGSAPGGSAPEAGRSANH |
| | TCAACCGAACCTTCCGAGGGCAGCGCACCGGGTGGCTCAGCGCCTGAGGCAGGT | TPAGLTGPATSGSETPGT |
| | CGTTCTGCTAACCATACCCCTGCAGGATTAACTGGCCCCGCCACCAGCGGGAGC | DIQMTQSPASLSASLGET |
| | GAGACCCCCGGGACTGACATCCAGATGACCCAAAGCCCGGCGAGCCTGAGCGCG | VSIECLASEGISNDLAWY |
| | AGCCTGGGTGAAACCGTGAGCATCGAATGCCTGGCGAGCGAGGGTATTAGCAAC | QQKSGKSPQLLIYATSRL |
| | GACCTGGCGTGGTACCAGCAAAAGAGCGGCAAAAGCCCGCAGCTGCTGATCTAT | QDGVPSRFSGSGSGTRYS |
| | GCGACCAGCCGTCTGCAAGATGGTGTTCCGAGCCGTTTCAGCGGTAGCGGTAGC | LKISGMQPEDEADYFCQQ |
| | GGTACCCGTTACAGCCTGAAGATTAGCGGTATGCAGCCGGAGGACGAAGCGGAT | SYKYPWTFGGGTKLELKG |
| | TATTTCTGCCAGCAAAGCTACAAATATCCGTGGACCTTTGGTGGCGGTACCAAG | ATPPETGAETESPGETTG |
| | CTGGAACTGAAAGGTGCAACGCCTCCGGAGACTGGTGCTGAAACTGAGTCCCCG | GSAESEPPGEGEVQLAES |
| | GGCGAGACGACCGGTGGCTCTGCTGAATCCGAACCACCGGGCGAAGGCGAAGTT | GGGLVQPGRSMKLSCAAS |
| | CAGCTGGCGGAAAGCGGCGGTGGCCTGGTGCAACCGGGCCGTAGCATGAAGCTG | GFTFSNFPMAWVRQAPTK |
| | AGCTGCGCGGCGAGCGGTTTCACCTTTAGCAACTTCCCGATGGCGTGGGTTCGT | GLEWVATISTSGGSTYYR |
| | CAAGCGCCGACCAAAGGCCTGGAATGGGTGGCGACCATCAGCACCAGCGGTGGC | DSVKGRFTISRDNAKSTL |
| | AGCACCTACTATCGTGACAGCGTTAAGGGTCGTTTTACCATTAGCCGTGATAAC | YLQMNSLRSEDTATYYCT |
| | GCGAAAAGCACCCTGTACCTGCAGATGAACAGCCTGCGTAGCGAGGACACCGCG | RTLYILRVEYFDYWGQGV |
| | ACCTACTATTGCACCCGTACCCTGTATATTCTGCGTGTGTTCTACTTTGATTAT | MVTVSSGGGGSELVVTQE |
| | TGGGGCCAAGGTGTGATGGTTACCGTGAGCAGCGGTGGTGGCGGCAGCGAGTTA | PSLTVSPGGTVTLTCRSS |
| | GTTGTGACCCAAGAGCCGAGCCTGACCGTTAGCCCGGGTGGTACGGTCACCCTG | TGAVTTSNYANWVQQKPG |
| | ACGTGCCGTAGCAGCACCGGTGCGGTCACGACCAGCAACTATGCCAATTGGGTC | QAPRGLIGGTNKRAPGTP |
| | CAGCAGAAACCGGGTCAAGCACCGCGTGGCCTGATCGGCGGCACCAATAAACGT | ARFSGSLLGGKAALTLSG |
| | GCCCCGGGTACTCCTGCGCGTTTCTCCGGTAGCCTGCTGGGCGGCAAAGCCGCT | VQPEDEAEYYCALWYSNL |
| | CTGACCCTGAGCGGTGTCCAGCCGGAAGATGAAGCGGAGTACTACTGCGCGCTG | WVFGGGTKLTVLGATPPE |
| | TGGTATTCCAATCTGTGGGTTTTTGGCGGCGGTACCAAGCTGACCGTATTGGGT | TGAETESPGETTGGSAES |
| | GCTACGCCACCGGAGACTGGCGCAGAAACGGAAAGCCCGGGTGAGACTACGGGT | EPPGEGEVQLLESGGGLV |
| | GGCTCTGCGGAGAGCGAACCTCCGGGTGAGGGTGAGGTCCAACTGCTGGAGTCT | QPGGSLKLSCAASGFTFN |
| | GGTGGTGGCCTGGTTCAACCGGGTGGCTCGTTGAAGCTGAGCTGTGCAGCTAGC | TYAMNWVRQAPGKGLEWV |
| | GGCTTTACCTTCAACACCTATGCGATGAATTGGGTTCGTCAGGCACCGGGTAAG | ARIRSKYNNYATYYADSV |
| | GGCCTGGAATGGGTGGCGCGTATCCGCTCCAAGTACAACAACTACGCGACCTAC | KDRFTISRDDSKNTAYLQ |
| | TACGCGGATAGCGTTAAAGACCGCTTCACGATTAGCCGTGACGATTCCAAGAAT | MNNLKTEDTAVYYCVRHG |
| | ACGGCATATCTGCAAATGAACAATCTGAAAACCGAAGATACCGCGGTGTATTAC | NFGNSYVSWFAYWGQGTL |
| | TGTGTGCGCCACGGCAATTTCGGCAACAGCTACGTGAGCTGGTTTGCATATTGG | VTVSSGTAEAASASGEAG |
| | GGTCAGGGCACCCTGGTGACCGTTAGCAGCGGCACCGCCGAAGCGGCTAGCGCC | RSANHTPAGLTGPPGSPA |
| | TCCGGAGAAGCTGGAAGAAGCGCCAATCACACACCAGCTGGACTTACAGGCCCG | GSPTSTEEGTSESATPES |
| | CCTGGTAGCCCCGCGGGGAGCCCTACAAGCACTGAGGAGGGCACATCTGAGTCC | GPGTSTEPSEGSAPGSPA |
| | GCTACCCCTGAGAGTGGACCCGGGACAAGCACTGAGCCTAGCGAAGGAAGCGCA | GSPTSTEEGTSTEPSEGS |
| | CCAGGTTCCCCCGCTGGGAGCCCCACAAGCACAGAAGAGGGAACTTCTACCGAG | APGTSTEPSEGSAPGTSE |
| | CCCTCTGAGGGCTCAGCCCCTGGAACTAGCACAGAGCCCTCCGAAGGCAGTGCA | SATPESGPGSEPATSGSE |
| | CCGGGTACTTCCGAAAGCGCAACTCCGGAATCCGGCCCTGGTTCTGAGCCTGCT | TPGSEPATSGSETPGSPA |
| | ACTTCCGGCTCTGAAACTCCAGGTAGCGAGCCAGCGACTTCTGGTTCTGAAACT | GSPTSTEEGTSESATPES |
| | CCAGGTTCACCGGCGGGTAGCCCGACGAGCACGGAGGAAGGTACCTCTGAGTCG | GPGTSTEPSEGSAPGTST |
| | GCCACTCCTGAGTCCGGTCCGGGCACGAGCACCGAGCCGAGCGAGGGTTCAGCC | EPSEGSAPGSPAGSPTST |
| | CCGGGTACCAGCACGGAGCCGTCCGAGGGTAGCGCACCGGGTTCTCCGGCGGGC | EEGTSTEPSEGSAPGTST |
| | TCCCCTACGTCTACGGAAGAGGGTACGTCCACTGAACCTAGCGAGGGCAGCGCG | EPSEGSAPGTSESATPES |
| | CCAGGCACCAGCACTGAACCGAGCGAAGGCAGCGCACCTGGCACTAGCGAGTCT | GPGTSTEPSEGSAPGTSE |
| | GCGACTCCGGAGAGCGGTCCGGGTACGAGCACGGAACCAAGCGAAGGCAGCGCC | SATPESGPGSEPATSGSE |
| | CCAGGTACCTCTGAATCTGCTACCCCAGAATCTGGCCCGGGTTCCGAGCCAGCT | TPGTSTEPSEGSAPGTST |
| | ACCTCTGGTTCTGAAACCCCAGGTACTTCCACTGAACCAAGCGAAGGTAGCGCT | EPSEGSAPGTSESATPES |
| | CCTGGCACTTCTACTGAACCATCCGAAGGTTCCGCTCCTGGTACGTCTGAAAGC | GPGTSESATPESGPGSPA |
| | GCTACCCCTGAAAGCGGCCCAGGCACCTCTGAAAGCGCTACTCCTGAGAGCGGT | GSPTSTEEGTSESATPES |
| | CCAGGCTCTCCAGCAGGTTCTCCAACCTCCACTGAAGAAGGCACCTCTGAGTCT | GPGSEPATSGSETPGTSE |
| | GCTACCCCTGAATCTGGTCCTGGCTCCGAACCTGCTACCTCTGGTTCCGAAACT | SATPESGPGTSTEPSEGS |
| | CCAGGTACCTCGGAATCTGCGACTCCGGAATCTGGCCCGGGCACGAGCACGGAG | APGTSTEPSEGSAPGTST |
| | CCGTCTGAGGGTAGCGCACCAGGTACCAGCACTGAGCCTTCTGAGGGCTCTGCA | EPSEGSAPGTSTEPSEGS |
| | CCGGGTACCTCCACGGAACCTTCGGAAGGTTCTGCGCCGGGTACCTCCACTGAG | APGTSTEPSEGSAPGTST |
| | CCATCCGAGGGTTCAGCACCAGGTACTAGCACGGAACCGTCCGAGGGCTCTGCA | EPSEGSAPGSPAGSPTST |
| | CCAGGTACGAGCACCGAACCGTCGGAGGGTAGCGCTCCAGGTAGCCCAGCGGGC | EEGTSTEPSEGSAPGTSE |
| | TCTCCGACAAGCACCGAAGAAGGCACCAGCACCGAGCCGTCCGAAGGTTCCGCA | SATPESGPGSEPATSGSE |
| | CCAGGTACAAGCGAGAGCGCGACTCCTGAATCTGGTCCGGGTAGCGAGCCTGCA | TPGTSESATPESGPGSEP |
| | ACCAGCGGTTCTGAGACGCCGGGCACTTCCGAATCTGCGACCCCGGAGTCCGGT | ATSGSETPGTSESATPES |
| | CCAGGTTCAGAGCCGGCGACGAGCGGTTCGGAAACGCCGGGTACGTCTGAATCA | GPGTSTEPSEGSAPGTSE |
| | GCCACGCCGGAGTCTGGTCCGGGTACCTCGACCGAACCAAGCGAAGGTTCGGCA | SATPESGPGSPAGSPTST |
| | CCGGGTACTAGCGAGAGCGCAACCCCTGAAAGCGGTCCGGGCAGCCCGGCAGGT | EEGSPAGSPTSTEEGSPA |
| | TCTCCAACCAGCACCGAAGAAGGTTCCCCTGCTGGTAGCCCGACCTCTACGGAG | GSPTSTEEGTSESATPES |
| | GAAGGTAGCCCTGCAGGTTCCCCAACTTCTACTGAGGAAGGTACTTCTGAGTCC | GPGTSTEPSEGSAPGTSE |
| | GCTACCCCAGAAAGCGGTCCTGGTACCTCCACTGAACCGTCTGAAGGCTCTGCA | SATPESGPGSEPATSGSE |
| | CCAGGCACTTCTGAGTCTGCTACTCCAGAAAGCGGCCCAGGTTCTGAACCAGCA | TPGTSESATPESGPGSEP |
| | ACTTCTGGCTCTGAGACTCCAGGCACTTCTGAGTCCGCAACGCCTGAATCCGGT | ATSGSETPGTSESATPES |
| | CCTGGTTCTGAACCAGCTACTTCCGGCAGCGAAACCCCAGGTACCTCTGAGTCT | GPGTSTEPSEGSAPGSPA |
| | GCGACTCCAGAGTCTGGTCCTGGTACTTCCACTGAGCCTAGCGAGGGTTCCGCA | GSPTSTEEGTSESATPES |
| | CCAGGTTCTCCGGCTGGTAGCCCGACCAGCACGGAGGAGGGTACGTCTGAATCT | GPGSEPATSGSETPGTSE |
| | GCAACGCCGGAATCGGGCCCAGGTTCGGAGCCTGCAACGTCTGGCAGCGAAACC | SATPESGPGSPAGSPTST |
| | CCGGGTACCTCCGAATCTGCTACACCGGAAAGCGGTCCTGGCAGCCCTGCTGGT | EEGSPAGSPTSTEEGTST |

TABLE 18-continued

DNA and amino acid sequence of ProTIA constructs of Example 45

| Construct Name | DNA Sequence | Amino Acid Sequence* |
|---|---|---|
| | TCTCCAACCTCTACCGAGGAGGGTTCACCGGCAGGTAGCCCGACTAGCACTGAA GAAGGTACTAGCACGGAGCCGAGCGAGGGTAGTGCTCCGGGTACGAGCGAGAGC GCAACGCCAGAGAGCGGTCCAGCGACCAGCGAATCGGCCACCCCTGAGAGCGGC CCAGGTACTTCTGAGAGCGCCCACTCCTGAATCCGGCCCTGGTAGCGAGCCGGCA ACCTCCGGCTCAGAAACTCCTGGTTCGGAACCAGCGACCAGCGGTTCTGAAACT CCGGGTAGCCCGGCAGGCAGCCCAACGAGCACCGAAGAGGGTACCAGCACGGAA CCGAGCGAGGGTTCTGCCCCGGGTACTTCCACCGAACCATCGGAGGGCTCTGCA CCTGGTAGCGAACCTGCGACGTCTGGTTCTGAAACGCCGGGTACCAGCGAAAGC GCTACCCCAGAATCCGGTCCGGGCACTAGCACCGAGCCATCGGAGGGCGCCGCA GAACCAGAGGCG (SEQ ID NO.: 1013) | EPSEGSAPGTSESATPES GPGTSESATPESGPGTSE SATPESGPGSEPATSGSE TPGSEPATSGSETPGSPA GSPTSTEEGTSTEPSEGS APGTSTEPSEGSAPGSEP ATSGSETPGTSESATPES GPGTSTEPSEGAAEPEA (SEQ ID NO.: 1023) |
| AC2078 | ATGAAGAAAAACATCGCTTTTCTTCTTGCATCTATGTTCGTTTTTTCTATTGCT ACAAACGCGTACGCTCACCATCATCACCATCACTCCCCAGCAGGCAGCCCGACC AGCACCGAGGAGGGTACGAGCGAGTCGGCTACTCCAGAGAGCGGTCCGGGTACC TCTACGGAACCGTCCGAAGGTAGCGCTCCAGGCACGTCTGAAAGCGCAGCGCCG GAAAGCGGTCCAGGCAGCGAGCCGGCGACCTCCGGTAGCGAAACGCCTGGTACC TCGGAGTCAGCGACTCCGGAAAGCGGTCCGGGTAGCGAACCTGCAACGAGCGGT AGCGAGACTCCAGGCACTAGCGAATCCGCAACTCCGGAGTCGGGTCCGGGCACC TCTACGGAGCCTAGCGAGGGCTCAGCACCAGGTAGCCCTGCAGGTTCCCCGACA TCAACCGAGGAAGGTACAAGCGAAAGCGCCACCCCTGAGTCGGGCCCTGGCAGC GAACCGGCAACTAGCGGCAGCGAGACTCCGGGTACCAGCGAGTCTGCTACGCCA GAGAGCGGCCCAGGTTCGCCAGCGGGTTCGCCGACTAGCACGGAGGAGGGCAGC CCAGCGGGTAGCCCGACCAGCACTGAGGAGGGTACGTCCACCGAACCGAGCGAA GGTAGCGCACCAGGTACCTCCGAGTCTGCCACCCCTGAATCCGGTCCAGGTACC AGCGAATCAGCCACCCCGGAGTCGGGTCCAGGTACGAGCGAATCTGCTACCCCG GAATCCGGCCCAGGCAGCGAACCTGCTACTAGCGGCAGCGAAACGCCGGGCAGC GAACCTGCCACGTCAGGCAGCGAGCGCCGGGTTCCCTGCAGGCTCCCCGACC AGCACTGAGGAGGGCACCTCCACCGAACCATCAGAAGGTAGCGCGCCTGGTACG TCAACCGAACCTTCCGAGGGCAGCGCACCGGGTGGCTCAGCGCCTGAGGCAGGT CGTTCTGCTAACCATACCCTGCAGGATTAACTGGCCCCGCCACCAGCGGGAGC GAGACCCCCGGGACTGACATCCAGATGACCCAAAGCCCGAGCGAGCCTGAGCG AGCCTGGGTGAAACCGTGAGCATCCAATGCCTGGCGAGCGAGGGTATTAGCAAC GACCTGGCGTGGTACCAGCAAAAGAGCGGCAAAAGCCCGCAGCTGCTGATCTAT GCGACCAGCCGTCTGCAAGATGGTGTTCCGAGCCGTTTCAGCGGTAGCGGTAGC GGTACCCGTTACAGCCTGAAGATTAGCGGTATGCAGCCGGAGGACGAAGCGGAT TATTTCTGCCAGCAAAGCTACAAATATCCGTGGACCTTTGGCGGTGGTACCAAG CTGGAACTGAAAGGTGCAACGCCTCCGGAGACTGGTGCTGAAACTGAGTCCCCG GGCGAGACGACCGGTGGCTCTGCTGAATCCGAACCACCGGGCGAAGGCGAAGTT CAGCTGGCGGAAAGCGGCGGTGGCCTGGTGCAACCGGGCCGTAGCATGAAGCTG AGCTGCGCGGCGAGCGGTTTCACCTTTAGCAACTTTCCGATGGCGTGGGTTCGT CAAGCGCCGACCAAAGGCCTGGAATGGGTGGCGACCATCAGCACCAGCGGTGGC AGCACCTACTATCGTGACAGCGTTAAGGGTCGTTTTACCATTAGCCGTGATAAC GCGAAAAGCACCCTGTACCTGCAGATGAACAGCCTGCGTAGCGAGGACACCGCG ACCTACTATTGCACCCGTACCCTGTATATTCTGCGTGTGTTCTATTTTGATTAT TGGGGCCAAGGTGTGATGGTTACCGTGAGCAGCGGTGGTGGCGGCAGCGATATC CAGATGACCCAAAGCCCGAGCAGCCTGCCGGCGAGCCTGGGTGACCGTGTGACC ATCAACTGCCAGGCGAGCCAAGATATTAGCAACTACCTGAACTGGTATCAGCAA AAGCCGGGCAAAGCGCCGAAGCTGCTGATTTACTATACCAACAAGCTGGCGGAT GGTGTTCCGAGCCGTTTCAGCGGTAGCGGCAGCGGTCGTGACAGCAGCTTTACC ATCAGCAGCCTGGAGAGCGAAGATATTGGTAGCTACTATTGCCAACAATACTAC AACTATCCGTGGACCTTCGGTCCGGGCACCAAACTGGAAATCAAAGGTGCGACC CCGCCGGAAACCGGTGCGGAAACCGAAAGCCCGGGTGAAACCACCGGTGGCAGC GCGGAGAGCGAACCGCCGGGTGAAGGTGAAGTGCAACTGGTGGAGAGCGGTGGT GGTCTGGTGCAACCGGGCAAGAGCCTGAAACTGAGCTGCGAAGCGAGCGGCTTT ACCTTTAGCGGTTATGGTATGCACTGGGTGCGTCAGGCGCCGGGTCGTGGCCTG GAGAGCGTTGCGTACATCACCAGCAGCAGCATCAACATTAAATATGCGGACGCG GTGAAGGGCCGTTTCACCGTTAGCCGTGATAACGCGAAAAACCTGCTGTTTCTG CAGATGAACATTCTGAAGAGCGAGGACACCGCGATGTACTATTGCGCGCGTTTC GACTGGGATAAAAACTATTGGGGTCAAGGCACCATGGTGACCGTTAGCAGCGGC ACCGCCGAAGCGGCTAGCGCCTCCGGAGAAGCTGGAAGAAGCGCCAATCACACA CCAGCTGGACTTACAGGCCCGCCTGGTTCCCCGCGGAGCCCTACAAGCACT GAGGAGGGCACATCTGAGTCCGCTACCCCTGAGAGTGGACCCGGGACAAGCACT GAGCCTAGCGAAGGAAGCGCACCAGGTTCCCCGCTGGGAGCCCACAAGCACA GAAGAGGGAACTTCTACCGAGCCCTCTGAGGGCTCAGCCCCTGGAACTAGCACA GAGCCCTCCGAAGGCAGTGCACCAGGTTCTCCGAAACGCAACTCCGGAATCC GGCCCTGGTTCTGAGCCTGCTACTTCCGGCTCTGAAACTCCAGGTAGCGAGCCA GCGACTTCTGGTTCTGAAACTCCAGGTTCACCGGCGGGTAGCCCGACGAGCACG GAGGAAGGTACCTCTGAGTCGGCCACTCCTGAGTCCGGTCCGGGCACGAGCACC GAGCCGAGCGAGGGTTCAGCCCCGGGTACCAGCACCGAACCGTCCGAGGGTAGC GCACCGGGTTCTCCGGCGGCTCCCCTACGTCTACGGAAGAGGGTACGTCCACT GAACCTAGCGAGGGCAGCGCGCCAGGCACCAGCACTGAACCGAGCGAAGGCAGC GCACCTGGCACTAGCGAGTCTGCGACTCCGGAGAGCGGTCCGGGTACGAGCACG GAACCAAGCGAAGGCAGCGCCCCAGGTACCTCTGAATCTGCTACCCCAGAATCT GGCCCGGGTTCCGAGCCAGCTACCTCTGGTTCTGAAACCCCAGGTACTTCCACT | HHHHHHSPAGSPTSTEEG TSESATPESGPGTSTEPS EGSAPGTSESATPESGPG SEPATSGSETPGTSESAT PESGPGSEPATSGSETPG TSESATPESGPGTSTEPS EGSAPGSPAGSPTSTEEG TSESATPESGPGSEPATS GSETPGTSESATPESGPG SPAGSPTSTEEGSPAGSP TSTEEGTSTEPSEGSAPG TSESATPESGPGTSESAT PESGPGTSESATPESGPG SEPATSGSETPGSEPATS GSETPGSPAGSPTSTEEG TSTEPSEGSAPGSTSTEPS EGSAPGGSAPEAGRSANH TPAGLTGPATSGSETPGT DIQMTQSPASLSASLGET VSIECLASEGISNDLAWY QQKSGKSPQLLIYATSRL QDGVPSRFSGSGSGTRYS LKISGMQPEDEADYFCQQ SYKYPWTFGGGTKLELKG ATPPETGAETESPGETTG GSAESEPPGEGEVQLAES GGGLVQPGRSMKLSCAAS GFTFSNFPMAWVRQAPTK GLEWVATISTSGGSTYYR DSVKGRFTISRDNAKSTL YLQMNSLRSEDTATYYCT RTLYILRVEYFDYWGQGV MVTVSSGGGGSDIQMTQS PSSLPASLGDRVTINCQA SQDISNYLNWYQQKPGKA PKLLIYYTNKLADGVPSR FSGSGSGRDSSETISSLE SEDIGSYYCQQYYNYPWT FGPGTKLEIKGATPPETG AETESPGETTGGSAESEP PGEGEVQLVESGGGLVQP GKSLKLSCEASGFTFSGY GMHWVRQAPGRGLESVAY ITSSSINIKYADAVKGRF TVSRDNAKNLLFLQMNIL KSEDTAMYYCARFDWDKN YWGQGTMVTVSSGTAEAA SASGEAGRSANHTPAGLT GPPGSPAGSPTSTEEGTS ESATPESGPGTSTEPSEG SAPGSPAGSPTSTEEGTS TEPSEGSAPGTSTEPSEG SAPGTSESATPESGPGSE PATSGSETPGSEPATSGS ETPGSPAGSPTSTEEGTS ESATPESGPGTSTEPSEG SAPGTSTEPSEGSAPGSP AGSPTSTEEGTSTEPSEG SAPGTSTEPSEGSAPGTS ESATPESGPGTSTEPSEG SAPGTSESATPESGPGSE PATSGSETPGTSTEPSEG SAPGTSTEPSEGSAPGTS |

TABLE 18-continued

DNA and amino acid sequence of ProTIA constructs of Example 45

| Construct Name | DNA Sequence | Amino Acid Sequence* |
|---|---|---|
| | GAACCAAGCGAAGGTAGCGCTCCTGGCACTTCTACTGAACCATCCGAAGGTTCC<br>GCTCCTGGTACGTCTGAAAGCGCTACCCCTGAAAGCGGCCCAGGCACCTCTGAA<br>AGCGCTACTCCTGAGAGCGGTCCAGGCTCTCCAGCAGGTTCCTCCAACCTCCACT<br>GAAGAAGGCACCTCTGAGTCTGCTACCCCTGAATCTGGTCCTGGCTCCGAACCT<br>GCTACCTCTGGTTCCGAAACTCCAGGTACCTCGGAATCTGCGACTCCGGAATCT<br>GGCCCGGGCACGAGCACGGAGCCGTCTGAGGGTAGCGCACCAGGTACCAGCACT<br>GAGCCTTCTGAGGGCTCTGCACCGGGTACCTCCACGGAACCTTCGGAAGGTTCT<br>GCGCCGGGTACCTCCACTGAGCCATCCGAGGGTTCAGCACCAGGTACTAGCACG<br>GAACCGTCCGAGGGCTCTGCACCAGGTACGAGCACCGAACCGTCGGAGGGTAGC<br>GCTCCAGGTAGCCCAGCGGGCTCTCCGACAAGCACCGAAGAAGGCACCAGCACC<br>GAGCCGTCCGAAGGTTCCGCACCAGGTACAAGCGAGAGCGCGACTCCTGAATCT<br>GGTCCGGGTAGCGAGCCTGCACCAGCAGGTTCTGAGACGCCGGGCACTTCCGAA<br>TCTGCGACCCCGGAGTCCGGTCCAGGTTCAGAGCCGGCGACGAGCGGTTCGGAA<br>ACGCCGGGTACGTCTGAATCAGCCACGCCGGAGTCTGGTCCGGGTACCTCGACC<br>GAACCAAGCGAAGGTTCGGCACCGGGTACTAGCGAGAGCGCAACCCCTGAAAGC<br>GGTCCGGGACCCGGCAGGTTCTCCAACCAGCACCGAAGAAGGTTCCCCTGCT<br>GGTAGCCCGACCTCTACGGAGGAAGGTAGCCCTGCAGGTTCCCCAACTTCTACT<br>GAGGAAGGTACTTCTGAGTCCGCTACCCCAGAAAGCGGTCCTGGTACCTCCACT<br>GAACCGTCTGAAGGCTCTGCACCAGGCACTTCTGAGTCTGCTACTCCAGAAAGC<br>GGCCCAGGTTCTGAACCAGGTAGCGAGCCTGCTCCAGGTTCTGAGACTCCCAGGCTCTGAG<br>TCCGCAACGCCTGAATCCGGTCCTGGTTCTGAACCAGCTACTTCCGGCAGCGAA<br>ACCCCAGGTACCTCTGAGTCTGCGACTCCAGAGTCTGGTCCTGGTACTTCCACT<br>GAGCCTAGCGAGGGTTCCGCACCAGGTTCTCCGGCTGGTAGCCCGACCAGCACG<br>GAGGAGGGTACGTCTGAATCTGCAGAGTCCGAATCGGGCCCAGGTTCGGAGCCT<br>GCAACGTCTGGCAGCGAAACCCCCGGGTACCTCCGAATCTGCTACACCGGAAAGC<br>GGTCCTGGCAGCCCTGCTGGTTCTCCAACCTCTACCGAGGAGGGTTCACCGGCA<br>GGTAGCCCGACTAGCACTGAAGAAGGTACTAGCACGGAGCCGAGCGAGGGTAGT<br>GCTCCGGGTACGAGCGAGAGCGCAACGCCAGAGAGCGGTCCAGGCACCAGCGAA<br>TCGGCCACCCCTGAGAGCGGCCCAGGTACTTCTGAGAGCGCCACTCCTGAATCC<br>GGCCCTGGTAGCGAGCCGGCAACCTCCGGCTCAGAAACTCCTGGTTCGGAACCA<br>GCGACCAGCGGTTCTGAAACTCCGGGTAGCCCGGCAGGCAGCCCAACGAGCACC<br>GAAGAGGGTACCAGCACGGAACCGAGCGAGGGTTCTGCCCCGGGTACTTCCACC<br>GAACCATCGGAGGGCTCTGCACCTGGTAGCGAACCTGCGACGTCTGGTTCTGAA<br>ACGCCGGGTACCAGCGAAAGCGCTACCCCAGAATCCGGTCCGGGCACTAGCACC<br>GAGCCATCGGAGGGCGCCGCAGAACCAGAGGCG<br>(SEQ ID NO.: 1014) | ESATPESGPGTSESATPE<br>SGPGSPAGSPTSTEEGTS<br>ESATPESGPGSEPATSGS<br>ETPGTSESATPESGPGTS<br>TEPSEGSAPGTSTEPSEG<br>SAPGTSTEPSEGSAPGTS<br>TEPSEGSAPGTSTEPSEG<br>SAPGTSTEPSEGSAPGSP<br>AGSPTSTEEGTSTEPSEG<br>SAPGTSESATPESGPGSE<br>PATSGSETPGTSESATPE<br>SGPGSEPATSGSETPGTS<br>ESATPESGPGTSTEPSEG<br>SAPGTSESATPESGPGSP<br>AGSPTSTEEGSPAGSPTS<br>TEEGSPAGSPTSTEEGTS<br>ESATPESGPGTSTEPSEG<br>SAPGTSESATPESGPGSE<br>PATSGSETPGTSESATPE<br>SGPGSEPATSGSETPGTS<br>ESATPESGPGTSTEPSEG<br>SAPGSPAGSPTSTEEGTS<br>ESATPESGPGSEPATSGS<br>ETPGTSESATPESGPGSP<br>AGSPTSTEEGSPAGSPTS<br>TEEGTSTEPSEGSAPGTS<br>ESATPESGPGTSESATPE<br>SGPGTSESATPESGPGSE<br>PATSGSETPGSEPATSGS<br>ETPGSPAGSPTSTEEGTS<br>TEPSEGSAPGTSTEPSEG<br>SAPGSEPATSGSETPGTS<br>ESATPESGPGTSTEPSEG<br>AAEPE TABLE 18-continued DNA and amino acid sequence of ProTIA constructs of Example 45

| Construct Name | DNA Sequence | Amino Acid Sequence* |
|---|---|---|
| | TTATCTGGAGTGCAGCCTGAGGATGAAGCCGAGTACTACTGCGCATTGTGGTAC<br>AGCAACCTGTGGGTGTTTGGGGGCGGAACCAAGTTGACCGTCCTGGGAGCTACC<br>CCCCCCGAAACTGGGGCCGAAACGGAATCTCCTGGTGAAACTACAGGGGGAAGT<br>GCAGAGAGCGAGCCACCAGGAGAGGGCGAAGTCCAGCTGCTCGAATCCGGAGGC<br>GGACTCGTGCAGCCAGGAGGAAGTCTTAAGCTCTCATGCGCCGCTAGCGGCTTT<br>ACCTTCAACACATACGCCATGAATTGGGTCCGACAGGCTCCCGGTAAAGGGCTG<br>GAATGGGTGGCTCGAATACGTTCGAAGTACAACAATTACGCTACTTACTACGCC<br>GACAGCGTGAAGGACCGATTCACCATTAGTCGGGACGATAGCAAGAATACAGCC<br>TACCTGCAGATGAACAACCTGAAGACCGAGGATACCGCGGTCTACTATTGTGTG<br>CGCCATGGCAATTTTGGCAACAGCTATGTGAGCTGGTTTGCCTATTGGGGCCAA<br>GGCACACTGGTTACCGTCTCATCTGGGACCGCTGAAGCCGCTAGCGCTTCTGGG<br>GAATCAGGAAGAGCCGCCAATACTGAACCCCCCGAGCTGGGCGCTGGCCCAGGT<br>TCCCCCGCGGGGTCCCCCACTTCTACTGAAGAGGGCACTTCCGAGAGCGCTACT<br>CCAGAGTCTGGCCCCGGAACATCCACTGAGCCTAGCGAGGGGTCGGCACCTGGG<br>TCACCCGCTGGCTCCCCAACTTCCACCGAGGAAGGGACATCAACCGAACCCTCT<br>GAGGGCTCCGCCCCCGGTACTTCCACGGAGCCTAGTGAAGGCAGTGCCCCGGGT<br>ACTTCCGAAAGCGCAACTCCGGAATCCGGCCCTGGTTCTGAGCCTGCTACTTCC<br>GGCTCTGAAACTCCAGGTAGCGAGCCAGCGACTTCTGGTTCTGAAACTCCAGGT<br>TCACCGGCGGGTAGCCCGACGAGCACGGAGGAAGGTACCTCTGAGTCGGCCACT<br>CCTGAGTCCGGTCCGGGCACGAGCCACCGAGCGAGCGAGGGTTCAGCCCCCGGGT<br>ACCAGCACGGAGCCGTCCGAGGGTAGCGCACCGGGTTCTCCGGCGGGCTCCCCT<br>ACGTCTACGAAGAGGGTACGTCCACTGAACCTAGCGAGGGCAGCGCGCCAGGC<br>ACCAGCACTGAACCGAGCGAAGGCAGCGCACCTGGCACTAGCGAGTCTGCGACT<br>CCGGAGAGCGGTCCGGGTACGAGCGAAGCCAAGCGAAGGCAGCGCCCCAGGT<br>ACCTCTGAATCTGCTACCCAGAATCTGGCCCGGGTTCCGAGCCAGCTACCTCT<br>GGTTCTGAAACCCCAGGTACTTCCACTGAACCAAGCGAAGGTAGCGCTCCTGGC<br>ACTTCTACTGAACCATCCGAAGGTTCCGCTCCTGGTACGTCTGAAAGCGCTACC<br>CCTGAAAGCGGCCCAGGCACCTCTGAAAGCGCTACTCCTGAGAGCGGTCCAGGC<br>TCTCCAGCAGGTTCTCCAACCTCCACTGAAGAAGGCACCTCTGAGTCTGCTACC<br>CCTGAATCTGGTCCTGGCTCCGAACCTGCTACCTCTGGTTCCGAAACTCCAGGT<br>ACCTCGGAATCTGCGACTCCGGAATCTGGCCCGGGCACGAGCACGGAGCCGTCT<br>GAGGGTAGCGCACCAGGTACCAGCACTGAGCCTTCTGAGGGCTCTGCACCCGGT<br>ACCTCCACGGAACCTTCGGAAGGTTCTGCGCCGGGTACCTCCACTGAGCCATCC<br>GAGGGTTCAGCACCAGGTACTAGCACGGAACCGTCCGAGGGCTCTGCACCAGGT<br>ACGAGCACCGAACCGTCGGAGGGTAGCGCTCCAGGTAGCCCAGCGGGCTCTCCG<br>ACAAGCACCGAAGAAGGCACCAGCACCGAGCCGTCCGAAGGTTCCGCACCAGGT<br>ACAAGCGAGAGCGACTCCTGAATCTGGTCCGGGTAGCGAGCCTGCAACCAGC<br>GGTTCTGAGACGCCGGGCACTTCCGAATCTGCGACCCCGGAGTCCGGTCCAGGT<br>TCAGAGCCGGCGACGAGCGGTTCGGAAACGCCGGGTACGTCGAATCAGCCACG<br>CCGGAGTCTGGTCCGGGTACCTCGACCGAACCAAGCGAAGGTTCGGCACCGGGT<br>ACTAGCGAGAGCGCAACCCTGAAAGCGGGTACCCGCCAGGTTCTCCA<br>ACCAGCACCGAAGAAGGTTCCCCTGCTGGTAGCCCGACCTCTACGGAGGAAGGT<br>AGCCCTGCAGGTTCCCCAACTTCTACTGAGGAAGGTACTTCTGAGTCCGCTACC<br>CCAGAAAGCGGTCCTGGTACCTCCACTGAACCGTCTGAAGGCTCTGCACCAGGC<br>ACTTCTGAGTCTGCTACTCCAGAAAGCGGCCCAGGTTCTGAACCAGCAACTTCT<br>GGCTCTGAGACTCCAGGCACTTCTGAGTCCGCAACGCCTGAATCCGGTCCTGGT<br>TCTGAACCAGCTACTTCCGGCAGCGAAACCCCAGGTACCTCTGAGTCTGCGACT<br>CCAGAGTCTGGTCCTGGTACTTCCACTGAGCCTAGCGAGGGTTCCGCACCAGGT<br>TCTCCGGCTGGTCCCGACCAGCACGGAGGGTACGTCTGAATCTGCAACG<br>CCGGAATCGGGCCCAGGTTCGGAGCCTGCAACGTCTGGCAGCGAAACCCCGGGT<br>ACCTCCGAATCTGCTACACCGGAAAGCGGTCCTGGCAGCCCTGCTGGTTCTCCA<br>ACCTCTACCGAGGAGGGTTCACCGGCAGGTAGCCCGACTAGCACTGAAGAAGGT<br>ACTAGCACGGAGCCGAGCGAGGTAGTGCCGGGTACGAGTGAATCGGCGACG<br>CCAGAGAGCGGTCCAGGCACCAGCGAATCGGCACCCCTGAGAGCGGCCCAGGT<br>ACTTCTGAGAGCGCCACTCCTGAATCCGGCCCTGGTAGCGAGCCGGCAACCTCC<br>GGCTCAGAAACTCCTGGTTCGGAACCAGCGACCAGCGGTTCTGAAACTCCGGGT<br>AGCCCGGCAGGCAGCCCAACGAGCACCGAAGAGGGTACCAGCACGGAACCGAGC<br>GAGGGTTCTGCCCCGGGTACTTCCACCGAACCATCGGAGGGCTCTGCACCTGGT<br>AGCGAACCTGCGACGTCTGGTTCTGAAACGCCGGGTACCAGCGAAAGCGCTACC<br>CCAGAATCCGGTCCGGGCACTAGCACCGAGCCATCGGAGGGCGCCGCAGAACCA<br>GAGGCG<br>(SEQ ID NO.: 1015) | FGGGTKLTVLGATPPETG<br>AETESPGETTGGSAESEP<br>PGEGEVQLLESGGGLVQP<br>GGSLKLSCAASGFTFNTY<br>AMNWVRQAPGKGLEWVAR<br>IRSKYNNYATYYADSVKD<br>RFTISRDDSKNTAYLQMN<br>NLKTEDTAVYYCVRHGNF<br>GNSYVSWFAYWGQGTLVT<br>VSSGTAEAASASGESGRA<br>ANTEPPELGAGPGSPAGS<br>PTSTEEGTSESATPESGP<br>GTSTEPSEGSAPGSPAGS<br>PTSTEEGTSTEPSEGSAP<br>GTSTEPSEGSAPGTSESA<br>TPESGPGSEPATSGSETP<br>GSEPATSGSETPGSPAGS<br>PTSTEEGTSESATPESGP<br>GTSTEPSEGSAPGTSTEP<br>SEGSAPGSPAGSPTSTEE<br>GTSTEPSEGSAPGTSTEP<br>SEGSAPGTSESATPESGP<br>GTSTEPSEGSAPGTSESA<br>TPESGPGSEPATSGSETP<br>GTSTEPSEGSAPGTSTEP<br>SEGSAPGTSESATPESGP<br>GTSESATPESGPGSPAGS<br>PTSTEEGTSESATPESGP<br>GSEPATSGSETPGTSESA<br>TPESGPGSTEPSEGSAP<br>GTSTEPSEGSAPGTSTEP<br>SEGSAPGTSTEPSEGSAP<br>GTSTEPSEGSAPGTSTEP<br>SEGSAPGSPAGSPTSTEE<br>GTSTEPSEGSAPGTSESA<br>TPESGPGSEPATSGSETP<br>GTSESATPESGPGSEPAT<br>SGSETPGTSESATPESGP<br>GTSTEPSEGSAPGTSESA<br>TPESGPGSPAGSPTSTEE<br>GSPAGSPTSTEEGSPAGS<br>PTSTEEGTSESATPESGP<br>GTSTEPSEGSAPGTSESA<br>TPESGPGSEPATSGSETP<br>GTSESATPESGPGSEPAT<br>SGSETPGTSESATPESGP<br>GTSTEPSEGSAPGSPAGS<br>PTSTEEGTSESATPESGP<br>GSEPATSGSETPGTSESA<br>TPESGPGSPAGSPTSTEE<br>GSPAGSPTSTEEGTSTEP<br>SEGSAPGTSESATPESGP<br>GTSESATPESGPGTSESA<br>TPESGPGSEPATSGSETP<br>GSEPATSGSETPGSPAGS<br>PTSTEEGTSTEPSEGSAP<br>GTSTEPSEGSAPGSEPAT<br>SGSETPGTSESATPESGP<br>GTSTEPSEGAAEPEA<br>(SEQ ID NO.: 1025) |
| AC1969 | ATGAAGAAAAACATCGCTTTTCTTCTTGCATCTATGTTCGTTTTTTCTATTGCT<br>ACAAACGCGTACGCTTCCCCAGCAGGCAGCCCGACCAGCACCGAGGAGGGTACG<br>AGCGAGTCGGCTACTCCAGAGAGCGGTCCGGGTACCTCTACGGAACCGTCCGAA<br>GGTAGCGCTCCAGGCACGTCTGAAAGCGCGACGCCGAAAGCGGTCCAGGCAGC<br>GAGCCGGCGACCTCCGGTAGCGAAACGCCTGGTACCTCGGAGTCAGCGACTCCG<br>GAAAGCGGTCCGGGTAGCGAACCTGCAACGAGCGGTAGCGAGACTCCAGGCACT<br>AGCGAATCGGCAACTCCCGAGAGCGGTCCACCTCTACGGAGCCTAGCGAA<br>GGCTCAGCACCAGGTAGCCCTGCAGGTTCCCCACGTCAACCGAGGAAGGTACA<br>AGCGAAAGCGCCACCCCTGAGTCGGGCCCTGGCAGCGAACCGGCAACTAGCGGC<br>AGCGAGACTCCGGGTACCAGCGAGTCTGCTACGCCAGAGAGCGGCCCAGGTTCG<br>CCAGCGGGTTCGCCGACTAGCACGGAGGAGGGCAGCCCAGCGGGTAGCCCGACC<br>TCTGAGGAGGGTAGCCCCAGCGGGTAGCCCTACTAGCACGGAGGAGGGCAGCCCAGCGGGTAGCCCGACC<br>AGCACTGAGGAGGGTACGTCCACCGAACCGAGCGAAGGTAGCGCACCAGGTACC | SPAGSPTSTEEGTSESAT<br>PESGPGTSTEPSEGSAPG<br>TSESATPESGPGSEPATS<br>GSETPGTSESATPESGPG<br>SEPATSGSETPGTSESAT<br>PESGPGTSTEPSEGSAPG<br>SPAGSPTSTEEGTSESAT<br>PESGPGSEPATSGSETPG<br>TSESATPESGPGSPAGSP<br>TSTEEGSPAGSPTSTEEG<br>TSTEPSEGSAPGTSESAT<br>PESGPGTSESATPESGPG |

TABLE 18-continued

DNA and amino acid sequence of ProTIA constructs of Example 45

| Construct Name | DNA Sequence | Amino Acid Sequence* |
|---|---|---|
| | TCCGAGTCTGCCACCCCTGAATCCGGTCCAGGTACCAGCGAATCAGCCACCCCG | TSESATPESGPGSEPATS |
| | GAGTCGGGTCCAGGTACGAGCGAATCTGCTACCCCGGAATCCGGCCCAGGCAGC | GSETPGSEPATSGSETPG |
| | GAACCTGCTACTAGCGGCAGCGAAACGCCGGGCAGCGAACCTGCCACGTCAGGC | SPAGSPTSTEEGTSTEPS |
| | AGCGAGACGCCGGGTTCCCCTGCAGGTCCCCGACCAGCACTGAGGAGGGCACC | EGSAPGTSTEPSEGSAPG |
| | TCCACCGAACCATCAGAAGGTAGCGCGCCTGGTACGTCAACCGAACCTTCCGAG | GSAPESGRAANTEPPELG |
| | GGCAGCGCACCGGGTGGCTCTGCTCCTGAATCAGGGAGAGCCGCGAACACAGAA | AGATSGSETPGTDIQMTQ |
| | CCACCCGAGCTCGGCGCCGGAGCCACCTCTGGCAGCGAGACACCTGGGACGGAC | SPSSLSASVGDRVTITCR |
| | ATCCAGATGACACAATCCCCAAGCTCACTGTCCGCATCCGTCGGCGACCGGGTT | STKSLLHSNGITYLYWYQ |
| | ACTATTACATGTCGCAGTACAAAGTCTCTGCTGCACTCTAACGGCATTACGTAC | QKPGKAPKLLIYQMSNLA |
| | CTGTACTGGTACCAGCAAAAGCCCGGCAAAGCCCCCAAGCTGCTGATTTATCAG | SGVPSRFSSSGSGTDFTL |
| | ATGAGTAATCTGGCATCCGGAGTACCGAGCCGGTTTTCCAGTTCTGGAAGCGGC | TISSLQPEDFATYYCAQN |
| | ACCGACTTCACGTTGACGTATCCAGCCTCCAGCCTGAGGATTTCGCCACCTAC | LEIPRTFGQGTKVEIKGA |
| | TACTGCGCTCAGAATCTGGAGATCCCCCGGACTTTCGGACAGGGCACAAAGGTG | TPPETGAETESPGETTGG |
| | GAGATTAAAGGCGCAACACCCCCCGAAACTGGAGCAGAAACTGAAAGCCCTGGA | SAESEPPGEGQVQLVQSG |
| | GAAACCACCGGCGGATCCGCCGAGTCAGAACCGCCAGGAGAAGGGCAAGTTCAG | PGLVQPGGSVRISCAASG |
| | CTCGTTCAGTCTGGCCCAGGACTCGTTCAGCCTGGTGGAAGTGTGAAGATAAGC | YTFTNYGMNWVKQAPGKG |
| | TGCGCTGCCTCTGGCTATACCTTCACGAATTACGGCATGAATTGGGTAAAACAG | LEWMGWINTYTGESTYAD |
| | GCCCCCGGAAAGGGCCTGGAGTGGATGGGCTGGATCAACACCTATACAGGAGAG | SFKGRFTFSLDTSASAAY |
| | AGTACCTATGCCGACTCATTTAAGGGGCGGTTCACCTTCAGCCTGGACACCTCT | LQINSLRAEDTAVYYCAR |
| | GCCTCCGCCGCCTACCTCCAAATTAACTCACTAAGAGCAGACACCGCGGTG | FAIKGDYWGQGTLLTVSS |
| | TATTATTGCGCAAGGTTTGCCATCAAAGGCGATTACTGGGGCAAGGCACCTTG | GGGGSDIQMTQSPSSLPA |
| | CTTACAGTGAGCTCTGGAGGAGGAGGTCAGACATTCAAATGACCCAGAGCCCA | SLGDRVTINCQASQDISN |
| | AGCAGTCTCCCAGCTAGTCTAGGGGATCGGGTTACCATAAATTGTCAGGCTTCT | YLNWYQQKPGKAPKLLTY |
| | CAAGATATTAGTAATTATCTGAACTGGTATCAACAGAAGCCCGGTAAAGCGCCA | YTNKLADGVPSRFSGSGS |
| | AAATTGCTCATCTACTATACGAATAAACTGGCAGATGGGGTACCCTCCAGATTC | GRDSSFTISSLESEDIGS |
| | TCCGGTAGTGGTTCAGGCCGGGACTCGTCGTTCACTATTAGCAGCCTGGAGTCT | YYCQQYYNYPWTFGPGTK |
| | GAGGATATAGGCAGCTACTACTGCCAGCAATATTACAACTATCCATGGACCTTC | LEIKGATPPETGAETESP |
| | GGGCCAGGCACCAAGCTGGAAATCAAGGGCGCAACACCGCCGAGACTGGTGCT | GETTGGSAESEPPGEGEV |
| | GAAACCGAAAGCCCCGGTGAAACAACAGGCGGCTCTGCAGAGTCGGAACCTCCC | QLVESGGGLVQPGKSLKL |
| | GGAGAGGGGAGGTGCAGCTGGTGGAAAGTGGAGGCGGACTGGTGCAACCTGGG | SCEASGFTFSGYGMHWVR |
| | AAAAGCCTGAAGCTGTCCTGTGAAGCATCGGGCTTTACATTTAGCGGGTATGGC | QAPGRGLESVAYITSSSI |
| | ATGCATTGGGTGCGGCAGGCGCCCGGTCGTGGCCTCGAATCTGTGGCCTACATC | NIKYADAVKGRFTVSRDN |
| | ACTAGCTCTTCAATCAACATCAAGTACGACCGATGCCGTGAAGGGCAGATTTACA | AKNLLFLQMNILKSEDTA |
| | GTGAGCCGGGATAATGCCAAGAACCTGCTGTTCCTTCAAATGAACATCCTAAAG | MYYCARFDWDKNYWGQGT |
| | AGCGAGGACACCGCCATGTACTACTGCGCAAGGTTCGACTGGGACAAGAATTAT | MVTVSSGTAEAASASGES |
| | TGGGGCCAGGGCACAATGGTAACAGTCTCTAGCGGGACAGCCGAGGCCGCTAGC | GRAANTEPPELGAGSPGS |
| | GCCTCTGGAGAGTCGGGGCGAGCGGCTAATACAGAACCACCTGAACTGGGTGCC | PAGSPTSTEEGTSESATP |
| | GGGTCTCCCGGTAGTCCTGCCGGGAGCCCCACAAGCACTGAAGAGGGAACCTCT | ESGPGTSTEPSEGSAPGS |
| | GAGTCAGCTACCCCGGAAAGCGGCCCCGGCACCTCTACGGAACCCTCCGAGGGA | PAGSPTSTEEGTSTEPSE |
| | TCTGCTCCAGGGTCCCCGGCCGGAAGCCCTACCTAACAGAAGAGGGCACGTCC | GSAPGTSTEPSEGSAPGT |
| | ACTGAGCCTGGCGAAGGGTCAGCCCCGGAGCAGCAGACCCTCAGAGGGC | SESATPESGPGSEPATSG |
| | AGTGCACCGGGTACTTCCGAAAGCGCAACTCCGGAATCCGGCCCTGGTTCTGAG | SETPGSEPATSGSETPGS |
| | CCTGCTACTTCCGGCTCTGAAACTCCAGGTAGCGAGCCAGCGACTTCTGGTTCT | PAGSPTSTEEGTSESATP |
| | GAAACTCCAGGTTCACCGGCGGGTAGCCCGACGAGCACGGAGGAAGGTACCTCT | ESGPGTSTEPSEGSAPGT |
| | GAGTCGGCCACTCCTGAGTCCGGTCCGGGCACGAGCGAGCCGAGGGT | STEPSEGSAPGSPAGSPT |
| | TCAGCCCCGGGTACCAGCACGGAGCCGTCCGAGGGTAGCGCACCGGGTTCTCCG | STEEGTSTEPSEGSAPGT |
| | GCGGGCTCCCCTACGTCTACGGAAGAGGGTACGTCCACTGAACCTAGCGAGGGC | STEPSEGSAPGTSESATP |
| | AGCGCGCCAGGCACCAGCACTGAACCGAGCGAAGGCAGCGCACCTGGCACTAGC | ESGPGTSTEPSEGSAPGT |
| | GAGTCTGCACTCCGGAGAGCGGTCCGGGTACGAGCGAGCCGAGCGAAGGC | SESATPESGPGSEPATSG |
| | AGCGCCCCAGGTACCTCTGAATCTGCTACCCCAGAATCTGGCCCGGGTTCCGAG | SETPGTSTEPSEGSAPGT |
| | CCAGCTACCTCTGGTTCTGAAACCCCAGGTACTTCCACTGAACCAAGCGAAGGT | STEPSEGSAPGTSESATP |
| | AGCGCTCCTGGCACTTCTACTGAACCATCCGAAGGTTCCGCTCCTGGTACGTCT | ESGPGTSESATPESGPGS |
| | GAAAGCGCTACCCCTGAAAGCGGCCCAGGCACCTCTGAAAGCGCTACTCCTGAG | PAGSPTSTEEGTSESATP |
| | AGCGGTCCAGGTCTCTCCAGCAGGTTCTCCAACCTCCACTGAAGAAGGCACCTCT | ESGPGSEPATSGSETPGT |
| | GAGTCTGCTACCCCTGAATCTGGTCCTGGCTCCGAACCTGCTACCTCTGGTTCC | SESATPESGPGTSTEPSE |
| | GAAACTCCAGGTACCTCGGAATCTGCGACTCCGGAATCTGGCCCGGGCACGAGC | GSAPGTSTEPSEGSAPGT |
| | ACGGAGCCGTCTGAGGGTAGCGCACCAGGTACCAGCACTGAGCCTTCTGAGGGC | STEPSEGSAPGTSTEPSE |
| | TCTGCACCGGGTACCTCCACGGAACCTTCGGAAGGTTCTGCGCCGGGTACCTCC | GSAPGTSTEPSEGSAPGT |
| | ACTGAGCCATCCGAGGGTTCAGCACCAGGTACTAGCACGGAACCGTCCGAGGGC | STEPSEGSAPGSPAGSPT |
| | TCTGCACCAGGTACGAGCACCGAACCGTCGGAGGGTAGCGCTCCAGGTAGCCCA | STEEGTSTEPSEGSAPGT |
| | GCGGGCTCTCCGACAAGCACCGAAGAAGGCACCAGCACCGAGCCGTCCGAAGGT | SESATPESGPGSEPATSG |
| | TCCGCACCAGGTACAAGCGAGAGCGCCCTTCCTGAATCTGGTCCGGGCAGCGAG | SETPGTSESATPESGPGS |
| | CCTGCAACCAGCGGTTCTGAGACGCCGGGCACTTCCGAATCTGCGACCCCGGAG | EPATSGSETPGTSESATP |
| | TCCGGTCCAGGTTCAGAGCCGGCGACGAGCGGTTCGGAAACGCCGGGTACGTCT | ESGPGTSTEPSEGSAPGT |
| | GAATCAGCCACGCCGGAGTCTGGTCCGGGTACCTCGACCGAACCAAGCGAAGGT | SESATPESGPGSPAGSPT |
| | TCGGCACCGGGTACTAGCGAGAGCGCAACCCCGTCTGAAGGCAGCGAGCCCCCG | STEEGSPAGSPTSTEEGS |
| | GCAGGTTCTCCAACCAGCACCGAAGAAGGTTCCCCTGCTGGTAGCCCCGACCTCT | PAGSPTSTEEGTSESATP |
| | ACGGAGGAAGGTAGCCCTGCAGGTTCCCCAACTTCTACTGAAGAAGGTACTTCT | ESGPGTSTEPSEGSAPGT |
| | GAGTCCGCTACCCCAGAAAGCGGTCCTGGTACCTCCACTGAACCGTCTGAAGGC | SESATPESGPGSEPATSG |
| | TCTGCACCAGGTACTTCTGAGTCTGCTACCAGAAGCGGCCTCCAGGTACCTGAA | SETPGTSESATPESGPGS |
| | CCAGCAACTTCTGGCTCTGAGACTCCAGGCACTTCTGAGTCCGCAACGCCTGAA | EPATSGSETPGTSESATP |
| | TCCGGTCCTGTTCTGAACCAGCTACTTCCGGCAGCGAAACCCCAGGTACCTCT | ESGPGTSTEPSEGSAPGS |
| | GAGTCTGCGACTCCAGAGTCTGGTCCTGGTACTTCCACTGAGCCTAGCGAGGGT | PAGSPTSTEEGTSESATP |
| | TCCGCACCAGGTTCCGGCTGGTAGCCCGACCAGCACGGAGGAGGGTACGTCT | ESGPGSEPATSGSETPGT |
| | GAATCTGCAACGCCGGAATCGGGCCCAGGTTCGGAGCCTGCAACGTCTGGCAGC | SESATPESGPGSPAGSPT |

TABLE 18-continued

DNA and amino acid sequence of ProTIA constructs of Example 45

| Construct Name | DNA Sequence | Amino Acid Sequence* |
|---|---|---|
| | GAAACCCCGGGTACCTCCGAATCTGCTACACCGGAAAGCGGTCCTGGCAGCCCT<br>GCTGGTTCTCCAACCTCTACCGAGGAGGGTTCACCGGCAGGTAGCCCGACTAGC<br>ACTGAAGAAGGTACTAGCACGGAGCGAGCGAGGGTAGTGCTCGGGTACGAGC<br>GAGAGCGCAACGCCAGAGAGCGGTCCAGGCACCAGCGAATCGGCCACCCCTGAG<br>AGCGGCCCAGGTACTTCTGAGAGCGCCACTCCTGAATCCGGCCCTGGTAGCGAG<br>CCGGCAACCTCCGGCTCAGAAACTCCTGGTTCGGAACCAGCGACCAGCGGTTCT<br>GAAACTCCGGGTAGCCCGGCAGGCAGCCCAACGAGCACCGAAGAGGGTACCAGC<br>ACGGAACCGAGCGAGGGTTCTGCCCCGGGTACTTCCACCGAACCATCGGAGGGC<br>TCTGCACCTGGTAGCGAACCTGCGACGTCTGGTTCTGAAACGCGGGTACCAGC<br>GAAAGCGCTACCCCAGAATCCGGTCCGGGCACTAGCACCGAGCCATCGGAGGGC<br>TCCGCACCAGGTCACCATCATCACCATCAC<br>(SEQ ID NO.: 1016) | STEEGSPAGSPTSTEEGT<br>STEPSEGSAPGTSESATP<br>ESGPGTSESATPESGPGT<br>SESATPESGPGSEPATSG<br>SETPGSEPATSGSETPGS<br>PAGSPTSTEEGTSTEPSE<br>GSAPGTSTEPSEGSAPGS<br>EPATSGSETPGTSESATP<br>ESGPGTSTEPSEGSAPGH<br>HHHHH<br>(SEQ ID NO.: 1026) |
| AC1972 | ATGAAGAAAAACATCGCTTTTCTTCTTGCATCTATGTTCGTTTTTTCTATTGCT<br>ACAAACGCGTACGCTCACCATCATCACCATCACTCCCCAGCAGGCAGCCCGACC<br>AGCACCGAGGAGGGTACGAGCGAGTCTGCTACTCCAGAGAGCGGTCCGGGTACC<br>TCTACGGAACCGTCCGAAGGTAGCGCTCCAGGCACGTCTGAAAGCGCTGACGCG<br>GAAAGCGGTCCAGGCAGCGAGCCGGCGACCTCCGGTAGCGAAACGCCTGGTACC<br>TCGGAGTCAGCGACTCCGGAAAGCGGTCCGGGTAGCGAACCTGCAACGAGCGGT<br>AGCGAGCTTCCAGGCACTAGCGAATCCGCAACTCCGGAGTCGGGTCGGGCCGCT<br>TCTACGGAGCCTAGCGAGGGCTCAGCACCAGGTAGCCCTGCAGGTTCCCCGACG<br>TCAACCGAGGAAGGTACAAGCGAAAGCGCTCACCCCTGAGTCGGGCCCTGGCAGC<br>GAACCGGCAACTAGCGGCAGCGAGACTCCGGGTACCAGCGAGTCTGCTACGCCA<br>GAGAGCGGCCAGGTTCGCCAGCAGGGTTCGCCGACTACGGAGGAGGGCCAGGT<br>CCAGCGGGTAGCCCGACCAGCACTGAGGAGGGTACGTCCACCGAACCGAGCGAA<br>GGTAGCGCACCAGGTACCTCCGAGTCTGCCACCCCTGAATCCGGTCCAGGTACC<br>AGCGAATCAGCCACCCCGGAGTCGGGTCCAGGTACGAGCGAATCTGCTACCCCG<br>GAATCCGGCCCAGGCAGCAGCTGCTACTAGCGAACCGGAAGCGCGGGCAGC<br>GAACCTGCCACGTCAGGCAGCGAGACGCCGGGTTCCCCTGCAGGCTCCCCGACC<br>AGCACTGAGGAGGGCACCTCCACCGAACCATCAGAAGGTAGCGCGCCTGGTACG<br>TCAACCGAACCTTCCGAGGGCAGCGCACCGGGTGGCTCAGCGCCTGAATCTGGT<br>CGTGCAGCTAACACCGAACCTCTGAATTGGGAGCCGGTGCTACAAGCGGAAGT<br>GAGACCCCCGGGACCGATATCCAGATGACACAGAGCCCTTCTTCTCTGAGCGTC<br>TCTGTTGGCGATAGAGTGACAATCACCTGTAGGTCGACGAAGTCTCTGCTGCAC<br>AGCAATGGCATCACCTACCTATACTGGTATCAACAAAAGCCGGGTAAAGCACCT<br>AAACTGCTGATCTACCAGATGAGTAATCTGGCCTCTGGAGTTCCTAGCCGATTT<br>TCTTCATCTGGCTCTGGCACCGATTTTACACTGACCATCTCTAGCCTGCAGCCT<br>GAGGATTTTGCCACCTACTATTGCGCCCAGAACCTGGAAATCCCAAGGACATTT<br>GGACAGGGCACCAAGGTGGAGATTAAGGGGCAACACCTCCTGAAACAGGGGCC<br>GAGACAGAGAGCCCCGGTGAGACAACTGGCGGGTCTGCTGAGAGCGAGCCTCCC<br>GGTGAAGGACAGGTCCAACTGGTTCAGTCTGGGCCTGGGCTGGTCCAGCCCGGC<br>GGTTCCGTGAGGATTAGTTGTGCTGCCAGCGGCTACACTTTTCACCAATTATGGG<br>ATGAACTGGGTTAAGCAGGCCCCAGGTAAGGGTCTGGAATGGATGGGCTGGATC<br>AACACTTACACCGGAGAATCTACCTATGCCGATTCCTTCAAAGGGAGGTTTACT<br>TTCTCTCTGGACACCAGTGCCAGTGCCGCTTACCTGCAGATCAATTCATTGAGG<br>GCGGAAGATACCGCGGTGTATTACTGCGCCCGGTTCGCTATCAAAGGCGACTAT<br>TGGGGGCAAGGTACGTTACTAACAGTGTCGTCTGGCGGGGAGGATCTGAATTA<br>GTTGTGACCCAAGAGCCAAGCCTGACTGTGAGCCCAGGCGGCACAGTGACCCTG<br>ACCTGTCGCTCCTCCACCGGAGCTGTGACAACCAGCAATTATGCCAACTGGGTG<br>CAGCAGAAACCAGGTCAGGCACCGCGTGGACTTATTGGCGGCACCAACAAAGA<br>GCTCCAGGAACACCAGCCAGATTTCTGGCTCTCTGCTTGGCGGAAAAGCTGCC<br>CTGACATTATCTGGAGTTCAGCCTGAAGATGAGGCGGAATATTACTGTGCTCTG<br>TGGTACAGCAACCTGTGGGTGTTTGGAGGAGGTACCAAACTCACAGTTCTGGGA<br>GCCACCCCCCCAGAGACTGGTGCTGAACGGAATCTCCAGGAGAAACCACTGGA<br>GGATCAGCTGAGAGCGAACCACCCGGAGAGGGCGAAGTCAGCTCCTCGAATCC<br>GGGGGCGGTTTAGTTCAGCCCGGAGGTTCTCTCAAGCTGAGCTGTGCAGCTAGC<br>GGATTCACATTTAACACATATGCCATGAATTGGGTGCGGCAGGCTCCCGGTAAG<br>GGTCTGGAGTGGGTGGCCCGAATCCGCAGCAGGTACAATAACTACGCCACGTAC<br>TATGCCGACTCCGTGAAGGACAGGTTCACTATATCTCGCGACGATAGCAAGAAT<br>ACAGCCTACCTGCAGATGAACAACCTCAAAACAGAGGACACCGCGGTATATTAT<br>TGCGTGAGACACGGGAACTTTGGAAACAGCTATGTGAGCTGGTTTGCCTACTGG<br>GGTCAGGGCACCCTGGTAACCGTGAGCTCTGGGACAGCCGAGGCCGCTAGCGCC<br>TCCGGCGAATCCGGAAGAGCCGCCAATACTGAACCTCCCGAACTCGGCGCCGGT<br>CCTGGTAGTCCCGCGGGCTCTCCAACATCAACCGAAGAGGGCACTAGCGAATCC<br>GCAACCCCTGAGAGCGGGCCCGGCACTTCTACCGAACCTTCGGAGGGCTCAGCC<br>CCTGGCTCGCCCGCTGGTAGTCCCACCTCAGGGAAGGCACAAGCACCGAG<br>CCCTCAGAGGGCAGCGCACCCGGTACATCCACAGAGCCCTCTGAGGGCAGTGCT<br>CCGGGTACTTCCGAAAGCGCAACTCCGGAATCCGGCCCTGGTTCTGAGCCTGCT<br>ACTTCCGGCTCTGAAACTCCAGGTAGCGAGCCAGCGACTTCTGGTTCTGAAACT<br>CCAGGTTCACCGGCCAGGTAGCCCGACAGCACGGAGGAAGGTACCTCTGAGTCG<br>GCCACTCCTGAGTCCGGTCCGGGCACGAGCACCGAGCCGAGCGAGGGTTCAGCC<br>CCGGGTACCAGCACGGAGCCGTCCGAGGGTAGCGCACCGGGTTCCCGGCGGC<br>TCCCCTACGTCTACGGAAGAGGGTACGTCCACTGAACCTAGCGAGGGCAGCGCG<br>CCAGGCACCAGCACTGAACGAGCGAAGGCAGCGCACCTGGCACTAGCGAGTCT<br>GCGACTCCGGAGAGCGGTCCGGGTACGAGCACGGAACCAAGCGAAGGCAGCGCC | HHHHHHSPAGSPTSTEEG<br>TSESATPESGPGTSTEPS<br>EGSAPGTSESATPESGPG<br>SEPATSGSETPGTSESAT<br>PESGPGSEPATSGSETPG<br>TSESATPESGPGTSTEPS<br>EGSAPGSPAGSPTSTEEG<br>TSESATPESGPGSEPATS<br>GSETPGTSESATPESGPG<br>SPAGSPTSTEEGSPAGSP<br>TSTEEGTSTEPSEGSAPG<br>TSESATPESGPGTSESAT<br>PESGPGTSESATPESGPG<br>SEPATSGSETPGSEPATS<br>GSETPGSPAGSPTSTEEG<br>TSTEPSEGSAPGTSTEPS<br>EGSAPGGSAPESGRAANT<br>EPPELGAGATSGSETPGT<br>DIQMTQSPSSLSASVGDR<br>VTITCRSTKSLLHSNGIT<br>YLYWYQQKPGKAPKLLTY<br>QMSNLASGVPSRFSSSGS<br>GTDFTLTISSLQPEDFAT<br>YYCAQNLEIPRTFGQGTK<br>VEIKGATPPETGAETESP<br>GETTGGSAESEPPGEGQV<br>QLVQSGPGLVQPGGSVRI<br>SCAASGYTFTNYGMNWVK<br>QAPGKGLEWMGWINTYTG<br>ESTYADSFKGRFTFSLDT<br>SASAAYLQINSLRAEDTA<br>VYYCARFAIKGDYWGQGT<br>LLTVSSGGGGSELVVTQE<br>PSLTVSPGGTVTLTCRSS<br>TGAVTSNYANWVQQKPG<br>QAPRGLIGGTNKRAPGTP<br>ARFSGSLLGGKAALTLSG<br>VQPEDEAEYYCALWYSNL<br>WVFGGGTKLTVLGATPPE<br>TGAETESPGETTGGSAES<br>EPPGEGEVQLLESGGGLV<br>QPGGSLKLSCAASGFTFN<br>TYAMNWVRQAPGKGLEWV<br>ARIRSKYNNYATYYADSV<br>KDRFTISRDDSKNTAYLQ<br>MNNLKTEDTAVYYCVRHG<br>NFGNSYVSWFAYWGQGTL<br>VTVSSGTAEAASASGESG<br>RAANTEPPELGAGPGSPA<br>GSPTSTEEGTSESATPES<br>GPGTSTEPSEGSAPGSPA<br>GSPTSTEEGTSTEPSEGS<br>APGTSTEPSEGSAPGTSE<br>SATPESGPGSEPATSGSE<br>TPGSEPATSGSETPGSPA<br>GSPTSTEEGTSESATPES<br>GPGTSTEPSEGSAPGTSE<br>EPSEGSAPGSPAGSPTST<br>EEGTSTEPSEGSAPGTST<br>EPSEGSAPGTSESATPES<br>GPGTSTEPSEGSAPGTSE<br>SATPESGPGSEPATSGSE |

TABLE 18-continued

DNA and amino acid sequence of ProTIA constructs of Example 45

| Construct Name | DNA Sequence | Amino Acid Sequence* |
|---|---|---|
| | CCAGGTACCTCTGAATCTGCTACCCCAGAATCTGGCCCGGGTTCCGAGCCAGCT | TPGTSTEPSEGSAPGTST |
| | ACCTCTGGTTCTGAAACCCCAGGTACTTCCACTGAACCAAGCGAAGGTAGCGCT | EPSEGSAPGTSESATPES |
| | CCTGGCACTTCTACTGAACCATCCGAAGGTTCCGCTCCTGGTACGTCTGAAAGC | GPGTSESATPESGPGSPA |
| | GCTACCCCTGAAAGCGGCCCAGGCACCTCTGAAAGCGCTACTCCTGAGAGCGGT | GSPTSTEEGTSESATPES |
| | CCAGGCTCTCCAGCAGGTTCTCCAACCTCCACTGAAGAAGGCACCTCTGAGTCT | GPGSEPATSGSETPGTSE |
| | GCTACCCCTGAATCTGGTCCTGGCTCCGAACCTGCTACCTCTGGTTCCGAAACT | SATPESGPGTSTEPSEGS |
| | CCAGGTACCTCGGAATCTGCGATCCGGAATCTGGCCCGGGCACGAGCACGGAG | APGTSTEPSEGSAPGTST |
| | CCGTCTGAGGGTAGCGCACCAGGTACCAGCACTGAGCTTCTGAGGGCTCTGCA | EPSEGSAPGTSTEPSEGS |
| | CCGGGTACCTCCACGGAACCTTCGGAAGGTTCTGCGCCGGGTACCTCCACTGAG | APGTSTEPSEGSAPGTST |
| | CCATCCGAGGGTTCAGCACCAGGTACTAGCACGGAACCGTCCGAGGGCTCTGCA | EPSEGSAPGSPAGSPTST |
| | CCAGGTACGAGCACCGAACCGTCGGAGGGTAGCGCTCCAGGTAGCCCAGCGGGC | EEGTSTEPSEGSAPGTSE |
| | TCTCCGACAAGCACCGAAGAAGGCACCGACCGAGCCGTCGAAGGTTCCGCA | SATPESGPGSEPATSGSE |
| | CCAGGTACAAGCGAGAGCGCGACTCCTGAATCTGGTCCGGGTAGCGAGCCTGCA | TPGTSESATPESGPGSEP |
| | ACCAGCGGTTCTGAGACGCCGGGCACTTCCGAATCTGCGACCCCGGAGTCCGGT | ATSGSETPGTSESATPES |
| | CCAGGTTCAGAGCCGGCGACGAGCGGTTCGGAAACGCCGGGTACGTCTGAATCA | GPGTSTEPSEGSAPGTSE |
| | GCCACGCCGGAGTCTGGTCCGGGTACCTCGGCCGAACCAAGCGAAGGTTCGGCA | SATPESGPGSPAGSPTST |
| | CCGGGTACTAGCGAGAGCGCAACCCCTGAAAGCGGTCCGGGCAGCCCGGCAGGT | EEGSPAGSPTSTEEGSPA |
| | TCTCCAACCAGCACCGAAGAAGGTTCCCCTGCTGGTAGCCCGACCTCTACGGAG | GSPTSTEEGTSESATPES |
| | GAAGGTAGCCCTGCAGGTTCCCCAACTTCTACTGAGGAAGGTACTTCTGAGTCC | GPGTSTEPSEGSAPGTSE |
| | GCTACCCCAGAAAGCGGTCCTGGTACCTCCACTGAACCGTCTGAAGGCTCTGCA | SATPESGPGSEPATSGSE |
| | CCAGGCACTTCTGAGTCTGCTACTCCAGAAAGCGGCCCAGGTTCTGAACCAGCA | TPGTSESATPESGPGSEP |
| | ACTTCTGGCTCTGAGACTCCAGGCACTTCTGAGTCCGCAACGCCTGAATCCGGT | ATSGSETPGTSESATPES |
| | CCTGGTTCTGAACCAGCTACTTCCGGCAGCGAAACCCCAGGTACCTCTGAGTCT | GPGTSTEPSEGSAPGSPA |
| | GCGACTCCAGAGTCTGGTCCTGGTACTTCCACTGAGCCTAGCGAGGGTTCCGCA | GSPTSTEEGTSESATPES |
| | CCAGGTTCTCCGGCTGGTAGCCCGACCAGCACGGAGGAGGGTACGTCTGAATCT | GPGSEPATSGSETPGTSE |
| | GCAACGCCGGAATCGGGCCCAGGTTCGGAGCCTGCAACGTCTGGCAGCGAAACC | SATPESGPGSPAGSPTST |
| | CCGGGTACCTCCGAATCTGCTACACCGGAAAGCGGTCCTGGCAGCCCTGCTGGT | EEGSPAGSPTSTEEGTST |
| | TCTCCAACCTCTACCGAGGAGGGTTCACCGGCAGGTAGCCCGACTAGCACTGAA | EPSEGSAPGTSESATPES |
| | GAAGGTACTAGCACGGAGCCGAGCGAGGGTAGTGCTCCGGGTACGAGCGAGAGC | GPGTSESATPESGPGTSE |
| | GCAACGCCAGAGAGCGGTCCAGGCACCAGCGAATCGGCCACCCCTGAGAGCGGC | SATPESGPGSEPATSGSE |
| | CCAGGTACTTCTGAGAGCGCCACTCCTGAATCCGGCCCTGGTAGCGAGCCGGCA | TPGSEPATSGSETPGSPA |
| | ACCTCCGGCTCAGAAACTCCTGGTTCGGAACCAGCGACCAGCGGTTCTGAAACT | GSPTSTEEGTSTEPSEGS |
| | CCGGGTAGCCCGGCAGGCAGCCCAACGAGCACCGAAGAGGGTACCAGCACGGAA | APGTSTEPSEGSAPGSEP |
| | CCGAGCGAGGGTTCTGCCCCGGGTACTTCCACCGAACCATCGGAGGGCTCTGCA | ATSGSETPGTSESATPES |
| | CCTGGTAGCGAACCTGCGACGTCTGGTTCTGAAACGCCGGGTACCAGCGAAAGC | GPGTSTEPSEGAAEPEA |
| | GCTACCCCAGAATCCGGTCCGGGCACTAGCACCGAGCCATCGGAGGGCGCCGCA | (SEQ ID NO.: 1027) |
| | GAACCAGAGGCG | |
| | (SEQ ID NO.: 1017) | |

*underlined peptide represents the signal peptide.

Example 46: Production of Single-XTEN-ProTIA

EXPRESSION: Constructs conforming to the format aEpCAM-aCD3-RS-XTEN_AE864_His(6) were expressed in a proprietary E. coli AmE098 strain and partitioned into the periplasm via an N-terminal secretory leader sequence (MKKNIAFLLASMFVFSIATNAYA-; SEQ ID NO: 932), which was cleaved during translocation. Fermentation cultures were grown with animal-free complex medium at 37° C. and the temperature was shifted to 26° C. prior to phosphate depletion. During harvest, fermentation whole broth was centrifuged to pellet the cells. At harvest, the total volume and the wet cell weight (WCW; ratio of pellet to supernatant) were recorded, and the pelleted cells were collected and frozen at −80° C.

RECOVERY: The frozen cell pellet was resuspended in Lysis Buffer (17.7 mM citric acid, 22.3 mM $Na_2HPO_4$, 75 mM NaCl, 2 mM EDTA, pH 4.0) targeting 30% wet cell weight. The resuspension was allowed to equilibrate at pH 4 then homogenized via two passes at 800±50 bar while output temperature was monitored and maintained at 15±5° C. The pH of the homogenate was confirmed to be within the specified range (pH 4.0±0.2).

CLARIFICATION: To reduce endotoxin and host cell impurities, the homogenate was allowed to undergo low-temperature (10±5° C.), acidic (pH 4.0±0.2) flocculation overnight (15-20 hours). To remove the insoluble fraction, the flocculated homogenate was centrifuged for 40 minutes at 16,900 RCF at 2-8° C., and the supernatant was retained. The supernatant was diluted approximately 3-fold with Milli-Q water (MQ), then adjusted to 7±1 mS/cm with 5 M NaCl. To remove nucleic acid, lipids, and endotoxin and to act as a filter aid, the supernatant was adjusted to 0.1% (m/m) diatomaceous earth. To keep the filter aid suspended, the supernatant was mixed via impeller and allowed to equilibrate for 30 minutes. A filter train, consisting of a depth filter followed by a 0.22 μm filter, was assembled then flushed with MQ. The supernatant was pumped through the filter train while modulating flow to maintain a pressure drop of 25±5 psig. To adjust the composite buffer system (based on the ratio of citric acid and $Na_2HPO_4$) to the desired range for capture chromatography, the filtrate was adjusted with 500 mM $Na_2HPO_4$ such that the final ratio of $Na_2HPO_4$ to citric acid was 9.33:1, and the pH of the buffered filtrate was confirmed to be within the specified range (pH 7.0±0.2).

PURIFICATION: AEX Capture: To separate dimer, aggregate, and large truncates from monomeric product, and to remove endotoxin and nucleic acids, anion exchange (AEX) chromatography was utilized to capture the electronegative C-terminal XTEN domain (AE864). The AEX1 stationary phase (GE Q Sepharose FF), AEX1 mobile phase A (12.2 mM $Na_2HPO_4$, 7.8 mM $NaH_2PO_4$, 40 mM NaCl), and AEX1 mobile phase B (12.2 mM $Na_2HPO_4$, 7.8 mM $NaH_2PO_4$, 500 mM NaCl) were used herein. The column was equilibrated with AEX1 mobile phase A. Based on the total protein concentration measured by bicinchoninic acid (BCA) assay, the filtrate was loaded onto the column targeting 28±4 g/L-resin, chased with AEX1 mobile phase A, then washed with a step to 30% B. Bound material was eluted with a gradient from 30% B to 60% B over 20 CV. Fractions were collected in 1 CV aliquots while A220≥100 mAU above (local) baseline. Elution fractions were analyzed and pooled on the basis of SDS-PAGE and SE-HPLC.

IMAC Intermediate Purification: To ensure C-terminal integrity, immobilized metal affinity chromatography (IMAC) was used to capture the C-terminal polyhistidine tag (His(6)). The IMAC stationary phase (GE IMAC Sepharose FF), IMAC mobile phase A (18.3 mM $Na_2HPO_4$, 1.7 mM $NaH_2PO_4$, 500 mM NaCl, 1 mM imidazole), and IMAC mobile phase B (18.3 mM $Na_2HPO_4$, 1.7 mM $NaH_2PO_4$, 500 mM NaCl, 500 mM imidazole) were used herein. The column was charged with zinc solution and equilibrated with IMAC mobile phase A. The AEX1 Pool was adjusted to pH 7.8±0.1, 50±5 mS/cm (with 5 M NaCl), and 1 mM imidazole, loaded onto the IMAC column targeting 2 g/L-resin, and chased with IMAC mobile phase A until absorbance at 280 nm (A280) returned to (local) baseline. Bound material was eluted with a step to 25% IMAC mobile phase B. The IMAC Elution collection was initiated when A280≥10 mAU above (local) baseline, directed into a container pre-spiked with EDTA sufficient to bring 2 CV to 2 mM EDTA, and terminated once 2 CV were collected. The elution was analyzed by SDS-PAGE.

Protein-L Intermediate Purification: To ensure N-terminal integrity, Protein-L was used to capture kappa domains present close to the N-terminus of the molecule (specifically the aEpCAM scFv). Protein-L stationary phase (GE Capto L), Protein-L mobile phase A (16.0 mM citric acid, 20.0 mM $Na_2HPO_4$, pH 4.0±0.1), Protein-L mobile phase B (29.0 mM citric acid, 7.0 mM $Na_2HPO_4$, pH 2.60±0.02), and Protein-L mobile phase C (3.5 mM citric acid, 32.5 mM $Na_2HPO_4$, 250 mM NaCl, pH 7.0±0.1) were used herein. The column was equilibrated with Protein-L mobile phase C. The IMAC Elution was adjusted to pH 7.0±0.1 and 30±3 mS/cm (with 5 M NaCl and MQ) and loaded onto the Protein-L column targeting 2 g/L-resin then chased with Protein-L mobile phase C until absorbance at 280 nm (A280) returned to (local) baseline. The column was washed with Protein-L mobile phase A, and Protein-L mobile phases A and B were used to effect low-pH elution. Bound material was eluted at approximately pH 3.0 and collected into a container pre-spiked with one part 0.5 M $Na_2HPO_4$ for every 10 parts collected volume. Fractions were analyzed by SDS-PAGE.

HIC Polishing: To separate N-terminal variants (4 residues at the absolute N-terminus are not essential for Protein-L binding) and overall conformation variants, hydrophobic interaction chromatography (HIC) was used. HIC stationary phase (GE Capto Phenyl ImpRes), HIC mobile phase A (20 mM histidine, 0.02% (w/v) polysorbate 80, pH 6.5±0.1) and HIC mobile phase B (1 M ammonium sulfate, 20 mM histidine, 0.02% (w/v) polysorbate 80, pH 6.5±0.1) were used herein. The column was equilibrated with HIC mobile phase B. The adjusted Protein-L Elution was loaded onto the HIC column targeting 2 g/L-resin and chased with HIC mobile phase B until absorbance at 280 nm (A280) returned to (local) baseline. The column was washed with 50% B. Bound material was eluted with a gradient from 50% B to 0% B over 75 CV. Fractions were collected in 1 CV aliquots while A280≥3 mAU above (local) baseline. Elution fractions were analyzed and pooled on the basis of SE-HPLC and HI-HPLC.

Figure 84:
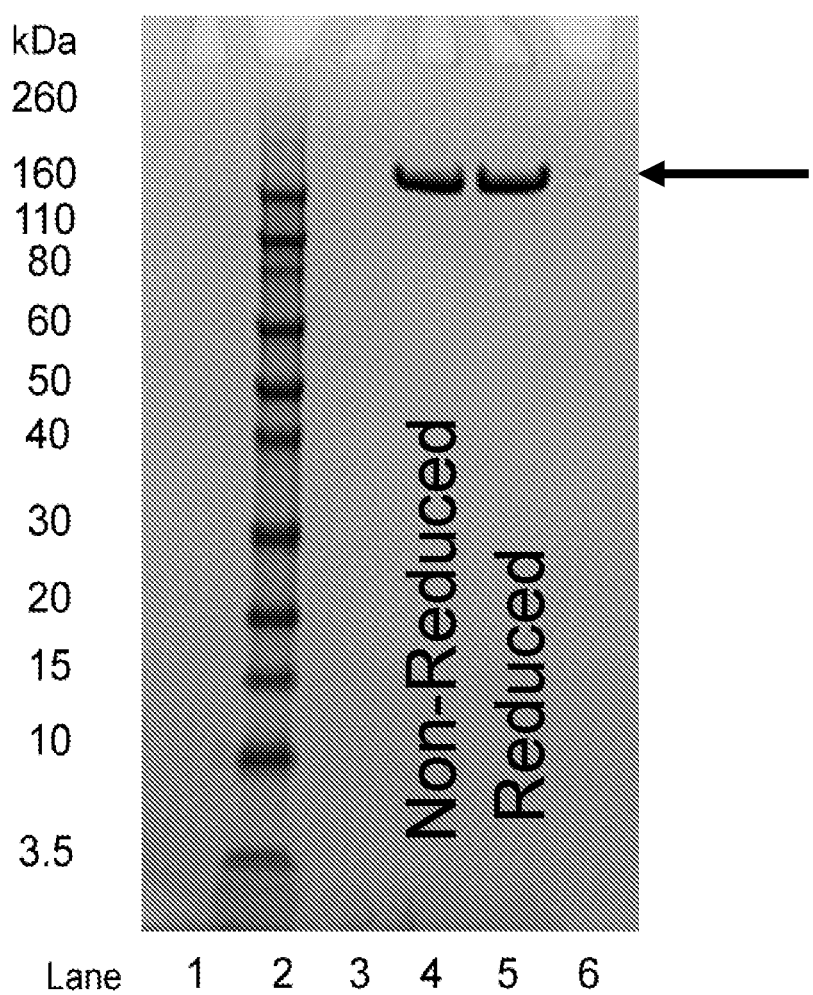
FIG. 84 shows an SDS-PAGE of the lot release analysis of formulated drug substance, as described in Example 46.

FORMULATION: To exchange the product into formulation buffer and to bring the product to the target concentration (0.5 g/L), anion exchange was again used to capture the C-terminal XTEN (AE864). AEX2 stationary phase (GE Q Sepharose FF), AEX2 mobile phase A (20 mM histidine, 40 mM NaCl, 0.02% (w/v) polysorbate 80, pH 6.5±0.2), AEX2 mobile phase B (20 mM histidine, 1 M NaCl, 0.02% (w/v) polysorbate 80, pH 6.5±0.2), and AEX2 mobile phase C (12.2 mM $Na_2HPO_4$, 7.8 mM $NaH_2PO_4$, 40 mM NaCl, 0.02% (w/v) polysorbate 80, pH 7.0±0.2) were used herein. The column was equilibrated with AEX2 mobile phase C. The HIC Pool was adjusted to pH 7.0±0.1 and 7±1 mS/cm (with MQ) and loaded onto the AEX2 column targeting 2 g/L-resin then chased with AEX2 mobile phase C until A280 returned to (local) baseline. The column was washed with AEX2 mobile phase A (20 mM histidine, 40 mM NaCl, 0.02% (w/v) polysorbate 80, pH 6.5±0.2). AEX2 mobile phases A and B were used to generate an [NaCl] step and effect elution. Bound material was eluted with a step to 38% AEX2 mobile phase B. The AEX2 Elution collection was initiated when A280≥5 mAU above (local) baseline and terminated once 2 CV were collected. The AEX2 Elution was 0.22 µm filtered within a BSC, aliquoted, labeled, and stored at −80° C. as Bulk Drug Substance (BDS). The bulk drug substance (BDS) was confirmed by various analytical methods to meet all lot release criteria. Overall quality was analyzed by SDS-PAGE (FIG. 84), the ratio of monomer to dimer and aggregate was analyzed by SE-HPLC (FIG. 85A), and N-terminal quality and product homogeneity were analyzed by HI-HPLC (FIG. 85B).

Example 47: Production of Double-XTEN-ProTIA

Molecule AC1955: His(6)_XTEN_AE288-RSR2295-aE-GFR-aCD3-RSR2295-XTEN_AE864_EPEA

EXPRESSION: AC1955 was expressed in a proprietary *E. coli* AmE098 strain and partitioned into the periplasm via an N-terminal secretory leader sequence (MKKNIAFL-LASMFVFSIATNAYA-; SEQ ID NO: 932), which was cleaved during translocation. Fermentation cultures were grown with animal-free complex medium at 37° C. and the temperature was shifted to 26° C. prior to phosphate depletion. During harvest, fermentation whole broth was centrifuged to pellet the cells. At harvest, the total volume and the wet cell weight (WCW; ratio of pellet to supernatant) were recorded, and the pelleted cells were collected and frozen at −80° C.

RECOVERY: The frozen cell pellet was resuspended in Lysis Buffer (100 mM citric acid) targeting 30% wet cell weight. The resuspension was allowed to equilibrate at pH 4.4 then homogenized at 17,000±200 bar while output temperature was monitored and maintained at 15±5° C. The pH of the homogenate was confirmed to be within the specified range (pH 4.4±0.1)

CLARIFICATION: To reduce endotoxin and host cell impurities, the homogenate was allowed to undergo low-temperature (10±5° C.), acidic (pH 4.4±0.1) flocculation overnight (15-20 hours). To remove the insoluble fraction, the flocculated homogenate was centrifuged for 40 minutes at 8,000 RCF and 2-8° C., and the supernatant was retained. To remove nucleic acid, lipids, and endotoxin and to act as a filter aid, the supernatant was adjusted to 0.1% (m/m) diatomaceous earth. To keep the filter aid suspended, the supernatant was mixed via impeller and allowed to equilibrate for 30 minutes. A filter train, consisting of a depth filter followed by a 0.22 µm filter, was assembled then flushed with MQ. The supernatant was pumped through the filter train while modulating flow to maintain a pressure drop of 25±5 psig.

PURIFICATION: Protein-L Capture: To remove host cell proteins, endotoxin, and nucleic acid, Protein-L was used to capture the kappa domain present within the aEGFR scFv of the AC1955 molecule. The Protein-L stationary phase (Tosoh TP AF-rProtein L-650F), Protein-L mobile phase A (11.5 mM citric acid, 24.5 mM $Na_2HPO_4$, 125 mM NaCl, 0.005% polysorbate 80, pH 5.0), and Protein-L mobile phase B (11 mM phosphoric acid, 0.005% polysorbate 80, pH 2.0) were used herein. The column was equilibrated with Protein-L mobile phase A. The filtrate was adjusted to pH 5.5±0.2 and loaded onto the Protein-L column targeting 2-4 g/L-resin then chased with Protein-L mobile phase A until absorbance at 280 nm (A280) returned to (local) baseline. Bound material was eluted with mobile phase B and collected as a 2 CV fraction pre-spiked with 0.4 CV of 0.5 M $Na_2HPO_4$ and was analyzed by SDS-PAGE.

IMAC Intermediate Purification: To ensure N-terminal integrity, Immobilized Metal Affinity Chromatography (IMAC) was used to capture the N-terminal polyhistidine tag (His(6)) of the AC1955 molecule. The IMAC stationary phase (GE IMAC Sepharose FF), IMAC mobile phase A (12.2 mM $Na_2HPO_4$, 7.8 mM $NaH_2PO_4$, 500 mM NaCl, 0.005% polysorbate 80, pH 7.0), and IMAC mobile phase B (50 mM histidine, 200 mM NaCl, 0.005% polysorbate 80, pH 6.5) were used herein. The column was equilibrated with IMAC mobile phase A. The Protein-L Elution was adjusted to pH 7.8±0.1 and 50±5 mS/cm (with 5 M NaCl). The adjusted Protein-L Pool was loaded onto the IMAC column targeting 2 g/L-resin and chased with IMAC mobile phase A until absorbance at 280 nm (A280) returned to (local) baseline. Bound material was eluted with IMAC mobile phase B. The IMAC Elution was collected as a 2 CV fraction pre-spiked with 0.02 CV 200 mM EDTA and was analyzed by SDS-PAGE.

C-tag Intermediate Purification: To ensure C-terminal integrity, C-tag Affinity Chromatography was used to capture the C-terminal-EPEA tag. The C-tag stationary phase (Thermo C-tagXL), C-tag mobile phase A (50 mM histidine, 200 mM NaCl, 0.005% polysorbate 80, pH 6.5), and C-tag mobile phase B (20 mM Tris, 0.6 M $MgCl_2$, 0.005% polysorbate 80, pH 7.0) were used herein. The column was equilibrated with C-tag mobile phase A. The IMAC Elution was loaded onto the C-tag column targeting 2 g/L-resin and chased with C-tag mobile phase A until absorbance at 280 nm (A280) returned to (local) baseline. Bound material was eluted with a C-tag mobile phase B. The C-tag Elution was collected as a 2 CV fraction and was analyzed by SDS-PAGE.

AEX Polishing: To separate dimer and aggregate from monomeric product Anion Exchange (AEX) chromatography was utilized to capture the electronegative N- and C-terminal XTEN domains. The AEX1 stationary phase (BIA QA-80), AEX1 mobile phase A (50 mM histidine, 200 mM NaCl, 0.005% polysorbate 80, pH 6.5), and AEX1 mobile phase B (50 mM histidine, 500 mM NaCl, 0.005% polysorbate 80, pH 6.5) were used herein. The column was equilibrated with AEX mobile phase A. The C-tag elution was diluted to 10 mS/cm with MQ, loaded targeting 2 g/L-resin, and then chased with AEX mobile phase A until absorbance at 280 nm returned to (local) baseline. Bound material was eluted with a gradient from 0% B to 100% B over 60 CV. Fractions were collected in 1 CV aliquots while A280≥2 mAU above (local) baseline. Elution fractions were analyzed by SDS-PAGE and SE-HPLC, and fractions found to be ≥98% monomer were pooled (AEX Pool) for further processing.

FORMULATION: To exchange the product into formulation buffer and to bring the product to the target concentration (0.5 g/L), Ultrafiltration/Diafiltration (UF/DF) was used. Using a 10 kDa membrane with an area of 0.1 m² and a TMP target of 15 psi, the AEX pool was concentrated to 0.5 g/L, then diluted 10-fold with Formulation Buffer (50 mM histidine, 200 mM NaCl, 0.005% polysorbate 80, pH 6.5). The AEX pool was concentrated 10-fold and diluted 10-fold two more times. The recovered Formulated product was 0.22 µm filtered within a BSC, aliquoted, labeled, and stored at −80° C. as Bulk Drug Substance (BDS). The BDS was confirmed by various analytical methods to meet all Lot Release criteria. Overall quality was analyzed by SDS-PAGE (FIG. 86A), the ratio of monomer to dimer and aggregate was analyzed by SE-HPLC (FIG. 87A), and N-product homogeneity was analyzed by HI-HPLC (FIG. 87B). Identity was confirmed by ESI-MS (FIG. 86B).

Example 48: Cell Binding Assessed by Flow Cytometry

Bispecific binding of the anti-EGFR×anti-CD3 ProTIA composition is also evaluated by flow cytometry-based assays utilizing CD3 positive human Jurkat cells and EGFR positive human cells selected from HT-29, HCT-116, NCI-H1573, NCI-H1975, FaDu, and SCC-9 or a stable CHO cell line expressing EGFR. CD3⁺ and EGFR⁺ cells are incubated with a dose range of untreated anti-EGFR×anti-CD3 ProTIA (AC1955, comprising 2 XTEN and 2 RS), protease-treated AC1955, and anti-CD3 scFv and anti-EGFR scFv positive controls for 30 min at 4° C. in binding buffer containing HBSS with 2% BSA and 5 mM EDTA. After washing with binding buffer to remove unbound test material, cells are incubated with FITC-conjugated anti-His tag antibody (Abcam cat #ab1206) for 30 min at 4° C. Unbound FITC-conjugated antibody is removed by washing with binding buffer and cells resuspended in binding buffer for acquisition on a FACS Calibur flow cytometer (Becton Dickerson) or equivalent instrument. All flow cytometry data are analyzed with FlowJo software (FlowJo LLC) or equivalent.

While anti-EGFR scFv is not expected to bind to Jurkat cells, anti-CD3 scFv, untreated AC1955 and protease-treated AC1955 are all expected to bind to Jurkat cells as indicated by an increase in fluorescence intensity when compared to Jurkat cells incubated with FITC-conjugated anti-His tag antibody alone. Similarly, anti-EGFR scFv, protease-treated and untreated AC1955 are all expected to bind to EGFR positive cells, while anti-CD3 scFv is not expected to bind to EGFR positive cells. It is expected that these data will reflect the bispecific binding ability of the anti-EGFR×anti-CD3 ProTIA composition to recognize both the CD3 and EGFR antigen expressed respectively on Jurkat and the panel of EGFR expressing human cell lines. Furthermore, due to the XTEN polymer providing some interference in surface binding, the untreated anti-EGFR×anti-CD3 ProTIA is expected to bind at a lower affinity than the protease-treated ProTIA for both the CD3 and EpCAM antigens.

Example 49: Cell Lysis Assessed by Flow Cytometry

Cell lysis by the anti-EGFR×anti-CD3 ProTIA composition is evaluated by flow cytometry utilizing human PBMCs and an EGFR positive cell line. EGFR positive HCT-116 target cells (or target cells selected from HT-29, NCI-H1573, NCI-H1975, FaDu, and SCC-9 or a stable CHO cell line expressing EGFR) are labeled with the fluorescent membrane dye CellVue Maroon dye (Affymetrix/eBioscience, cat #88-0870-16) according to manufacturer's instructions. Alternatively PKH26 (Sigma, cat #MINI26 and PKH26GL) can also be used. In brief, HCT-116 cells are washed twice with PBS followed by resuspension of $2 \times 10^6$ cells in 0.1 mL Diluent C provided with the CellVue Maroon labeling kit. In a separate tube, 2 microL of CellVue Maroon dye is mixed with 0.5 mL diluent C, and then 0.1 mL added to the HCT-116 cell suspension. The cell suspension and CellVue Maroon dye are mixed and incubated for 2 min at room temperature. The labeling reaction is then quenched by the addition of 0.2 mL of fetal bovine serum (FCS). Labeled cells are washed twice with complete cell culture medium (RPMI-1640 containing 10% FCS) and the total number of viable cells determined by trypan blue exclusion. For an effector to target ratio of 10:1 in a total volume of 200 microL per well, $1 \times 10^5$ PBMC are co-cultured with $1 \times 10^4$ CellVue Maroon-labeled HCT-116 cells per well in a 96-well round-bottom plate in the absence or presence of the indicated dose range concentration of protease-treated and untreated anti-EGFR×anti-CD3 ProTIA (AC1955, comprising 2 XTEN and 2 RS) samples. After 24 h, cells are harvested with Accutase (Innovative Cell Technologies, cat #AT104) and washed with 2% FCS/PBS. Before cell acquisition on a Guava easyCyte flow cytometer (Millipore), cells are resuspended in 100 microL 2% FCS/PBS supplemented with 2.5 micrograms/mL 7-AAD (Affymetrix/eBioscience, cat #00-6993-50) to discriminate between alive (7-AAD-negative) and dead (7-AAD-positive) cells. FACS data are analyzed with guavaSoft software (Millipore); and percentage of dead target cells is calculated by the number of 7-AAD-positive/CellVue Maroon-positive cells divided by the total number of CellVue Maroon-positive cells.

Dose response kill curves of percent cytotoxicity against ProTIA concentration are analyzed by 4 parameter-logistic regression equation using GraphPad Prism; and the concentration of ProTIA that induced half maximal percent cell cytotoxicity is thus determined.

Cytotoxicity results utilizing flow cytometry are expected to be in-line with results obtained with other cytotoxicity assays, including LDH and caspase. Exposure of HCT-116 cells to protease-cleaved and uncleaved anti-EGFR×anti-CD3 ProTIA compositions in the absence of PBMC are expected to have no effect. Similarly, PBMC are not expected to be activated in the presence of ProTIA without target cells. These results are expected to indicate that ProTIA compositions need to be clustered on the surface of target cells in order to stimulate PBMC for cytotoxicity activity. In the presence of PBMC and target cells, there would be a concentration-dependent cytotoxic effect due to ProTIA pretreated or untreated with protease. Further, results are expected to show that exposure of HCT-116 cells to untreated ProTIA (no protease) in the presence of PBMC would show reduced cytotoxicity as compared to protease-cleaved ProTIA composition.

Example 50: T-Cell Activation Marker Assays of Anti-EGFR×Anti-CD3 Protease Triggered Immune Activator (ProTIA) Composition To measure the anti-EGFR×anti-CD3 ProTIA induced activation markers (CD69 and CD25), $1 \times 10^5$ PBMC or purified CD3+ cells are co-cultured in RPMI-1640 containing 10% FCS with $1 \times 10^4$ HCT-116 or HT-29 cells per assay well (i.e., effector to target ratio of 10:1) in the presence of anti-EGFR×anti-CD3 ProTIA (AC1955, comprising 2 XTEN and 2 RS) in a 96-well round-bottom plate with total final volume of 200 microL. After 20 h incubation in a 37° C., 5% $CO_2$ humidified incubator, cells are stained with PECy5-conjugated anti-CD4, APC-conjugated anti-CD8, PE-conjugated anti-CD25, and FITC-conjugated anti-CD69 (all antibodies from BioLegend) in FACS buffer (1% BSA/PBS) at 4° C., washed twice with FACS buffer, and then re-suspended in FACS buffer for acquisition on a Guava easyCyte flow cytometer (Millipore).

The T-cell activation marker expression trend of the three ProTIA molecules is expected to be similar to that observed by cytotoxicity assays, including LDH and caspase. Activation of CD69 on CD8 and CD4 populations of PBMC or CD3+ cells by untreated anti-EGFR×anti-CD3 ProTIA (AC1955) is expected to be less active than protease-treated AC1955 ProTIA; and the non-cleavable anti-EGFR×anti-CD3 ProTIA (AC1991) is expected to be less active than the untreated AC1955.

Example 51: Cytometric Bead Array Analysis for Human Th1/Th2 Cytokines Using Stimulated Normal Healthy Human PBMCs and Intact and Protease-Treated Anti-EGFR×Anti-CD3 ProTIA As a safety assessment of the ability of intact versus cleaved anti-EGFR×anti-CD3 ProTIA (AC1955, comprising 2 XTEN and 2 RS) to stimulate release of T-cell related cytokines in a cell-based in vitro assay, a panel of cytokines including IL-2, IL-4, IL-6, IL-10, TNF-alpha, IFN-gamma are analyzed using the cytometric bead array (CBA) on supernatants from cultured human PBMC stimulated with protease-treated and untreated anti-EGFR×anti-CD3 ProTIA samples. The anti-human CD3 antibody, OKT3, is used as positive control and untreated wells serve as negative control.

Briefly, OKT3 (0, 10 nM, 100 nM and 1000 nM) and protease-treated and untreated anti-EGFR×anti-CD3 ProTIA (AC1955 at 10 nM, 100 nM, 1000 nM and 2000 nM) are dry-coated onto a 96-well flat bottomed plate by allowing the wells to evaporate overnight in the biosafety hood. Wells are then washed once gently with PBS and $1 \times 10^6$ PBMC in 200 microL were added to each well. The plate is then incubated at 37° C., 5% $CO_2$ for 24 h, after which tissue culture supernatant is collected from each well and analyzed for cytokine released using the validated commercial CBA kit (BD CBA human Th1/Th2 cytokine kit, cat #551809) by flow cytometry following manufacturer's instructions.

OKT3, but not untreated wells, is expected to induce robust secretion of all cytokines (IL-2, IL-4, IL-6, IL-10, TNF-alpha, IFN-gamma) evaluated, thereby confirming the performance of the CBA cytokine assay. Stimulation with protease-treated anti-EGFR×anti-CD3 ProTIA is expected to trigger significant cytokine expression, especially at concentrations higher than 100 nM for all of the cytokines tested. In contrast, baseline levels of IL-2, IL-6, IL-10, TNF-alpha and IFN-gamma are expected when the intact non-cleaved anti-EGFR×anti-CD3 ProTIA molecule is the stimulant at a concentration range of 10 to 2000 nM. These data support that the XTEN polymer of the intact ProTIA composition provides considerable shielding effect and hinders PBMC stimulated cytokine responses compared to the protease-treated ProTIA in which the EGFR×anti-CD3 portion is released from the composition.

Example 52: Cytotoxicity Assays of Anti-EGFR×Anti-CD3 Protease Triggered Immune Activator (ProTIA) Composition in the Presence of Purified CD3 Positive T Cells To demonstrate that cytotoxic activity of ProTIA molecules is mediated by CD3 positive T cells, non-cleavable anti-EGFR×anti-CD3 ProTIA without the release segment (AC1991, comprising 2 XTEN) and protease-treated and untreated anti-EGFR×anti-CD3 ProTIA (AC1955, comprising 2 XTEN and 2 RS) are evaluated in EGFR+ human cell lines (e.g. HCT-116 or HT-29) in the presence of purified human CD3 positive T cells. Purified human CD3 positive T cells are purchased from BioreclamationIV, where they are isolated by negative selection using MagCellect Human CD3+ T cell isolation kit from whole blood of healthy donors. In this experiment, purified human CD3 positive T cells are mixed with an EGFR+ cell line in a ratio of about 10:1 and all three ProTIA molecules were tested as a 12-point, 5× serial dilution dose curve in the LDH assay as described above. The activity trend of the three ProTIA molecules profiled with CD3+ cells is expected to be similar to the profile of the same cell line with PBMCs. Untreated AC1955 is expected to be less active than protease-treated AC1955; and the non-cleavable AC1991 is expected to be less active than untreated AC1955. Such results would demonstrate that cytotoxic activity of ProTIA molecules is indeed mediated by CD3 positive T cells. The susceptibility of the release segment contained within the cleavable anti-EGFR×anti-CD3 ProTIA molecule to proteases postulated to be released from the tumor cells and/or activated CD3 positive T cells in the assay mixture is likely to differ between cell lines.

Example 53: T-Cell Activation Marker and Cytokine Release Assays of Anti-EGFR×Anti-CD3 Protease Triggered Immune Activator (ProTIA) Composition To measure the anti-EGFR×anti-CD3 ProTIA induced expression of cytokines, purified CD3+ cells are co-cultured with HCT-116 cells per assay well (i.e., effector to target ratio of about 10:1) in the presence of anti-EGFR×anti-CD3 ProTIA (AC1955, comprising 2 XTEN and 2 RS) in a 96-well round-bottom plate with total final volume of 200 microL. After 20 h incubation in a 37° C., 5% $CO_2$ humidified incubator, cell supernatant is harvested for cytokine measurements. This assay can also be performed with other target cells selected from HT-29, NCI-H1573, NCI-H1975, FaDu, and SCC-9 as well as PBMC in place of purified CD3+ cells.

Cytokine analysis of interleukin (IL)-2, IL-4, IL-6, IL-10, tumor necrosis factor (TNF)-alpha and interferon (IFN)-gamma secreted into the cell culture supernatant is quantitated using the Human Th1/Th2 Cytokine Cytometric Bead Array (CBA) kit (BD Biosciences cat #550749) following manufacturer's instruction. In the absence of ProTIA, no cytokine secretion above background is expected from purified CD3+ cells. AC1955 in the presence of EGFR-positive target cells and purified CD3+ cells is expected to activate T cells and secrete a pattern of T cell cytokines with a high proportion of Th1 cytokines such as IFN-gamma and TNF-alpha. Compared to intact AC1955, lower concentrations of protease-treated AC1955 are expected to active T cells and secrete T cell cytokines, supporting the shielding effect of the XTEN polymer in ProTIA.

Example 54: Caspase 3/7 Assay of Anti-Mouse EpCAM×Anti-Mouse CD3 Protease Triggered Immune Activator (ProTIA) Composition Redirected cellular cytotoxicity of anti-mouse EpCAM× anti-mouse CD3 ProTIA compositions was assessed via assay of caspase 3/7 activities of apoptotic cells. Mouse splenocytes were mechanically dissociated from BALB/c mouse spleens by grinding between the ground-glass label end of two microscope slides, lysing red blood cells with ACK, and filtering through a 40 micrometer filter. Mouse CD3 cells were purified by negative selection from mouse splenocytes using EasySep Mouse T Cell Isolation Kit (StemCell cat #19851). Purified CD3 positive T cells were mixed with mouse EpCAM positive tumor target cells such as 4T1, msEp-CT26 (a stable pool of CT26 transfected with mouse EpCAM with mean mouse EpCAM density of 500, 000), and msEp-CT26-3 (a clone of CT26 transfected with mouse EpCAM with mean mouse EpCAM density of 410, 000 per cell) in a ratio of 5 or 10 effector cells to 1 target cell; and all three ProTIA versions were tested as an 8- or 12-point, 5× or 8× serial dilution dose concentrations.

Upon cell lysis, released caspase 3/7 in culture supernatants was measured by the amount of luminogenic caspase 3/7 substrate cleavage by caspase 3/7 to generate the "glow-type" luminescent signal (Promega Caspase-Glo 3/7 cat #G8091). The amount of luminescence is proportional to the amount of caspase activities.

Results: As shown in Table 19, the activity of the non-cleavable AC1867 and AC1554 are consistently poorer as compared to protease-untreated ProTIA (AC1696 and AC1553) in all mouse EpCAM expressing cell lines tested. As expected, protease-cleaved AC1696 and AC1553 were the most active, and cleavable, protease-untreated ProTIA constructs showed varying activities depending on the release segment sequence and target cell line.

TABLE 19

In vitro cytotoxicity activity of anti-mouse EpCAM × anti-mouse CD3 variants in mouse cell lines

| ProTIA | Release Segment | EC50 (pM) | | |
|---|---|---|---|---|
| | | 4T1 | msEp-CT26 pool | ms-Ep-CT26-3 |
| cleaved | cleaved | 128 | 6.8 | 5.0-13 |
| AC1696 | RSR-2089 | | | |
| AC1553 | BSRS-1 | 1831 | 240 | |
| AC1696 | RSR-2089 | 2000 | 286 | 140 |
| AC1598 | RSR-2295 | 3310 | 235 | 225 |
| AC1677 | RSR-2298 | 2400 | 140 | |
| AC1712 | RSR-2485 | | 2550 | 1600 |
| AC1713 | RSR-2486 | 4220 | 1000 | 510 |
| AC1690 | RSR-2488 | 8470 | 710 | |
| AC1710 | RSR-2599 | 2470 | 1220 | 1700 |
| AC1867 | RSR-3058 | | 2770 | 4800 |
| cleaved | cleaved | 83.3 | | |
| AC1553 | BSRS-1 | | | |
| AC1554 | none | 20800 | | |
| AC1868 | RSR-2783 | | 3700 | 2600 |
| AC1869 | RSR-2787 | | 4200 | |
| AC1870 | RSR-2789 | | 280 | 200 |
| AC1871 | RSR-3047 | | 3900 | |
| AC1872 | RSR-3052 | | 4000 | |
| AC1873 | RSR-3043 | | 160 | |
| AC1822 | RSR-2486 | | | 840 |
| AC1992 | RSR-3107 | | | 5400 |
| AC1993 | RSR-3103 | | | 4200 |

TABLE 19-continued

In vitro cytotoxicity activity of anti-mouse EpCAM × anti-mouse CD3 variants in mouse cell lines

| | | EC50 (pM) | | |
|---|---|---|---|---|
| ProTIA | Release Segment | 4T1 | msEp-CT26 pool | ms-Ep-CT26-3 |
| AC1994 | RSR-3102 | | | 5200 |
| AC1995 | RSR-3119 | | | 3400 |
| AC1996 | RSR-3110 | | | 1100 |
| AC1997 | RSR-3114 | | | 1200 |
| AC1998 | RSR-3115 | | | 1100 |
| AC1999 | RSR-3126 | | | 1700 |
| AC2000 | RSR-3127 | | | 2000 |

TABLE 20

In vitro cytotoxicity activity of anti-mouse EpCAM × anti-mouse CD3 variants in mouse cell lines

| | | EC50 (pM) | | | |
|---|---|---|---|---|---|
| ProTIA | Release Segment | hEp-CHO 4-12B | HCT-116 | hEp-LL/2 pool | hEp-LL/2 clones |
| AC1783 | cleaved RSR-2295 | 230 | 1040 | 370 | 670-6600 |
| cleaved AC1783 | cleaved RSR-2295 | 9.5 | 420 | 170 | 130-500 |
| cleaved AC1948 | RSR-2295 | 12 | | 180 | |
| AC1948 | RSR-2295 | 5650 | | 4100 | |
| AC1916 | RSR-3058 | 3050 | | >9000 | 3800-38000 |
| AC1949 | RSR-3058 | 240000 | | >100000 | |
| AC1957 | RSR-2295 | 255 | | | |
| AC1956 | RSR-3058 | 4900 | | | |

Example 55: Caspase 3/7 Assay of Anti-Human EpCAM×Anti-Mouse CD3 Protease Triggered Immune Activator (ProTIA) Composition Redirected cellular cytotoxicity of anti-human EpCAM× anti-mouse CD3 ProTIA compositions was assessed via assay of caspase 3/7 activities of apoptotic cells. Mouse splenocytes were mechanically dissociated from C57BL/6 mouse spleens by grinding between the ground-glass label end of two microscope slides, lysing red blood cells with ACK, and filtering through a 40 micrometer filter. Mouse CD3 cells were purified by negative selection from mouse splenocytes using EasySep Mouse T Cell Isolation Kit (StemCell cat #19851). Purified CD3 positive T cells were mixed with human EpCAM positive tumor target cells such as hEp-CHO 4-12B (a clone of CHO transfected with human EpCAM), HCT-116, hEp-LL/2 (a pool of Lewis Lung cell line transfected with human EpCAM), and hEp-LL/2-1 through hEp-LL/2-5 (five clones of Lewis Lung transfected with human EpCAM) in a ratio of 5 tor10 effector cells to 1 target cell; and all three ProTIA versions were tested as an 8- or 12-point, 5× or 8× serial dilution dose concentrations.

Upon cell lysis, released caspase 3/7 in culture supernatants was measured by the amount of luminogenic caspase 3/7 substrate cleavage by caspase 3/7 to generate the "glow-type" luminescent signal (Promega Caspase-Glo 3/7 cat #G8091). The amount of luminescence is proportional to the amount of caspase activities.

Figure 37:
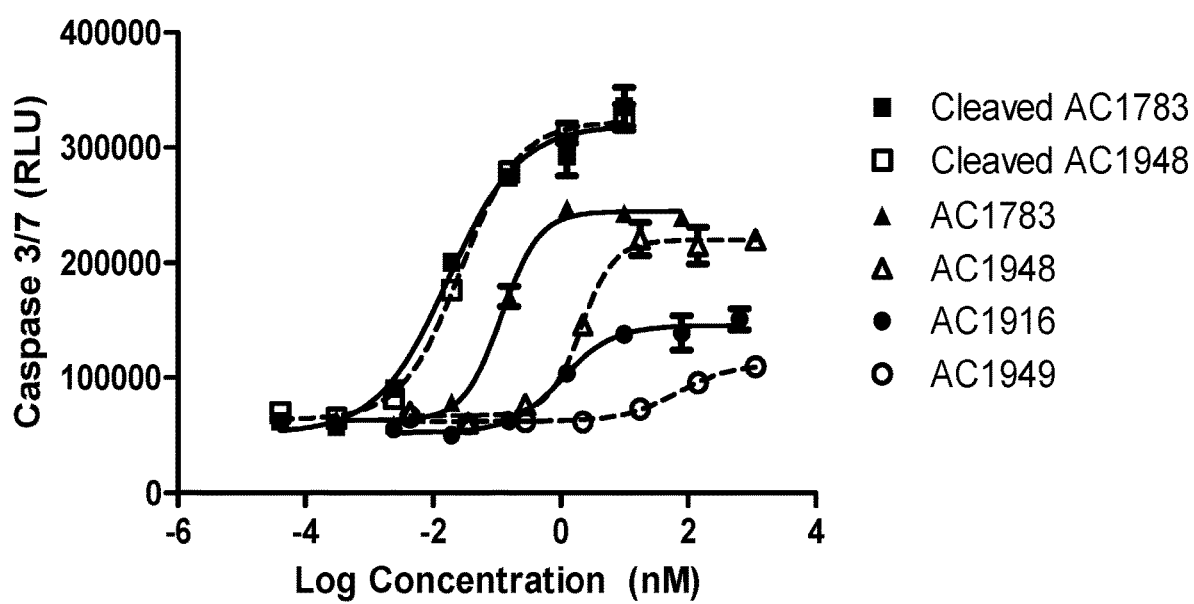
FIG. 37 depicts results from a cytotoxicity assay against huEp-CHO 4-12B measuring released caspase 3/7 in culture supernatants, as described in Example 55.

Results: As shown in Table 20, for ProTIA with a single XTEN moiety, the activity of the non-cleavable AC1916 is consistently poorer as compared to protease-untreated AC1783 in all human EpCAM expressing cell lines tested. For ProTIA with two XTEN moieties, the activity of the non-cleavable AC1949 and AC1956 are poorer as compared to the protease-untreated AC1948 and AC1957. Interestingly, the protease-untreated ProTIA with the human EpCAM scFv and mouse CD3 scFv (AC1948) were less active than the protease-untreated ProTIA with the human EpCAM and mouse CD3 single chain diabody (AC1957). This trend was also observed for the non-cleavable human EpCAM scFv and mouse CD3 scFv (AC1949) and non-cleavable ProTIA with the human EpCAM and mouse CD3 single chain diabody (AC1956). As expected, protease-cleaved AC1783 and AC1948 were the most active. Data for cytotoxicity against huEp-CHO 4-12B are included in FIG. 37.

Example 56: Determination of the Maximum Tolerated Dose of Anti-Human EpCAM×Anti-Mouse CD3 Protease Triggered Immune Activator (ProTIA) Composition in B6.FVB-Tg(TACSTD1)02Leij/J Mice Toxicity of ProTIA with a single XTEN was assessed in B6.FVB-Tg(TACSTD1)02Leij/J mice (Jackson Laboratory stock #008426) using a surrogate molecule that binds to human EpCAM and mouse CD3 proteins. B6.FVB-Tg (TACSTD1)02Leij/J is a hemizygous human EpCAM transgenic mouse line. The test articles were non-cleaved AC1783 (RSR-2295), cleaved AC1783, and non-cleavable AC1916 (RSR-3058). B6.FVB-Tg(TACSTD1)02Leij/J mice were dosed with varying amount of non-cleaved AC1783 (0.87, 2.6, and 8.7 nmol/kg), cleaved AC1783 (0.26, 0.87, and 2.6 nmol/kg), and non-cleavable AC1916 (2.6, 8.7, and 26.1 nmol/kg), and health and body weight of the mice were monitored for 14 days post-dosing.

Figure 77:
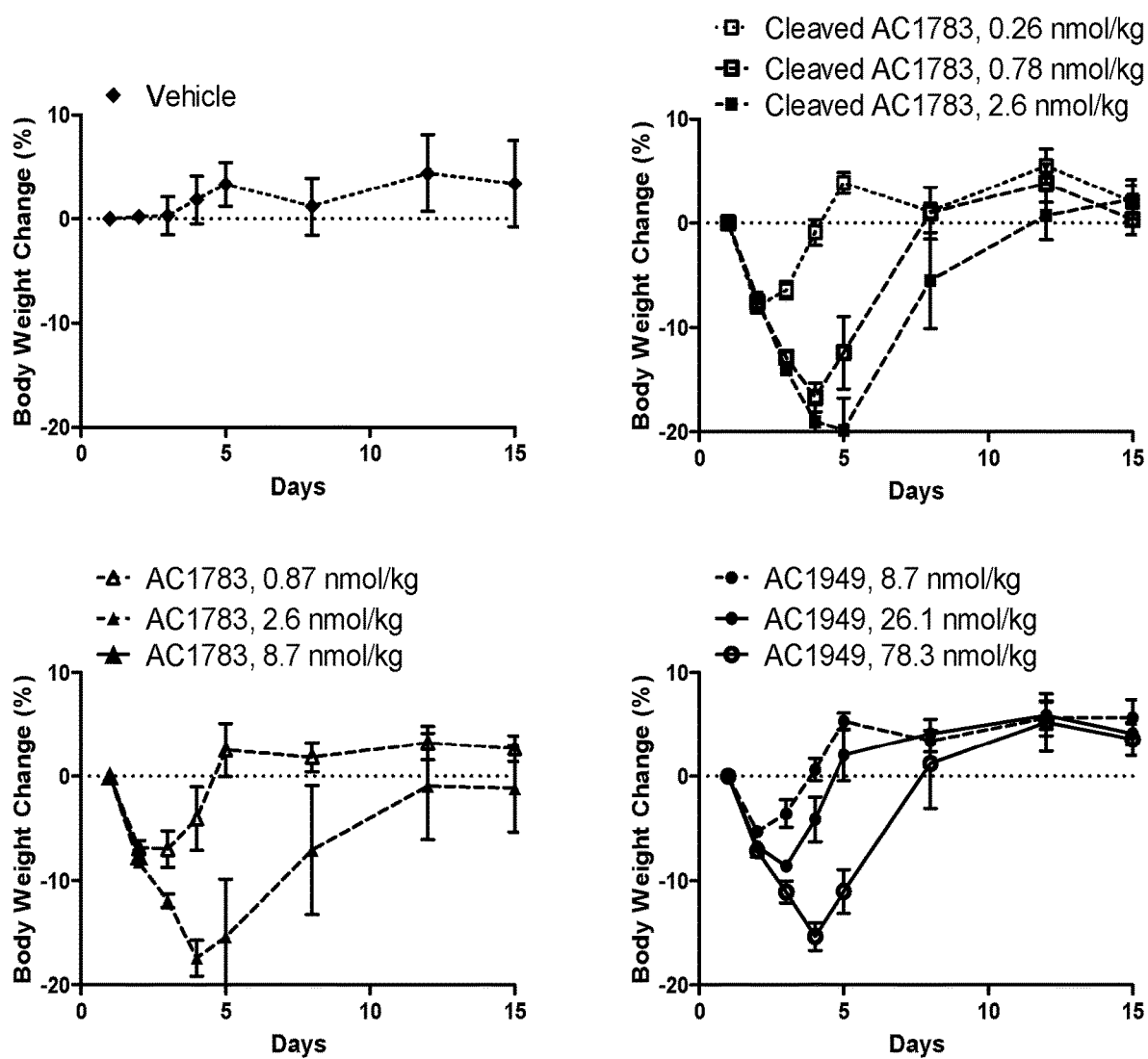
FIG. 77 shows results of body weight determinations in the vehicle and treatment groups, as described in Example 56.

Results: One out of five mice treated with 2.6 nmol/kg of AC1783 and all five mice treated with 8.7 nmol/kg of AC1783 died by the fifth day post-treatment. One out of five mice treated with 2.6 nmol/kg of protease cleaved AC1783 died by the eighth day post-treatment. One out of five mice treated with 26 nmol/kg of non-cleavable AC1916 died by the fifth day post-treatment. Dose-dependent body weight loss was observed for each test article (FIG. 77). The data observed indicate an MTD for non-cleaved AC1783 between 0.87 and 2.6 nmol/kg, for cleaved AC1783 between 0.87 nmol/kg and 2.6 nmol/kg, and for non-cleavable AC1916 between 8.7 and 26.1 nmol/kg.

Conclusions: Toxicity of anti-human EpCAM×anti-mouse CD3 ProTIA constructs, as assessed by body weight loss and death after a single dose, indicates that XTEN masks the in vivo activity, as observed by a 10-fold increase in MTD for non-cleavable AC1916 compared to cleaved AC1783. The non-cleaved AC1783 has a similar MTD as the cleaved AC1783, suggesting that in vivo cleavage of AC1783 occurs in the Tg(TACSTD1)02Leij/J transgenic mice.

Example 57: Determination of the Maximum Tolerated Dose of Anti-Human EpCAM×Anti-Mouse CD3 Protease Triggered Immune Activator (ProTIA) Composition in B6.FVB-Tg(TACSTD1)02Leij/J Mice Toxicity of ProTIA constructs with one or two XTEN was assessed in B6.FVB-Tg(TACSTD1)02Leij/J mice (Jackson Laboratory stock #008426) using a surrogate molecule that binds to human EpCAM and mouse CD3 proteins. B6.FVB-Tg(TACSTD1)02Leij/J is a hemizygous human EpCAM transgenic mouse line. The test articles were non-cleaved AC1783 (RSR-2295, single XTEN), non-cleaved AC1948 (RSR-2295, two XTEN), cleaved AC1948, and non-cleavable AC1949 (RSR-3058, two XTEN). B6.FVB-Tg(TACSTD1)02Leij/J mice were dosed with a varying amount of non-cleaved AC1783 (0.87, 2.6, and 8.7 nmol/kg), non-cleaved AC1948 (0.87, 2.6, 8.7, 26.1, and 78.3 nmol/kg), cleaved AC1948 (0.26, 0.87, 2.6, and 8.7 nmol/kg), or non-cleavable AC1949 (8.7, 26.1, and 78.3 nmol/kg), and health and body weight of the mice were monitored for 14 days post-dosing.

Figure 78:
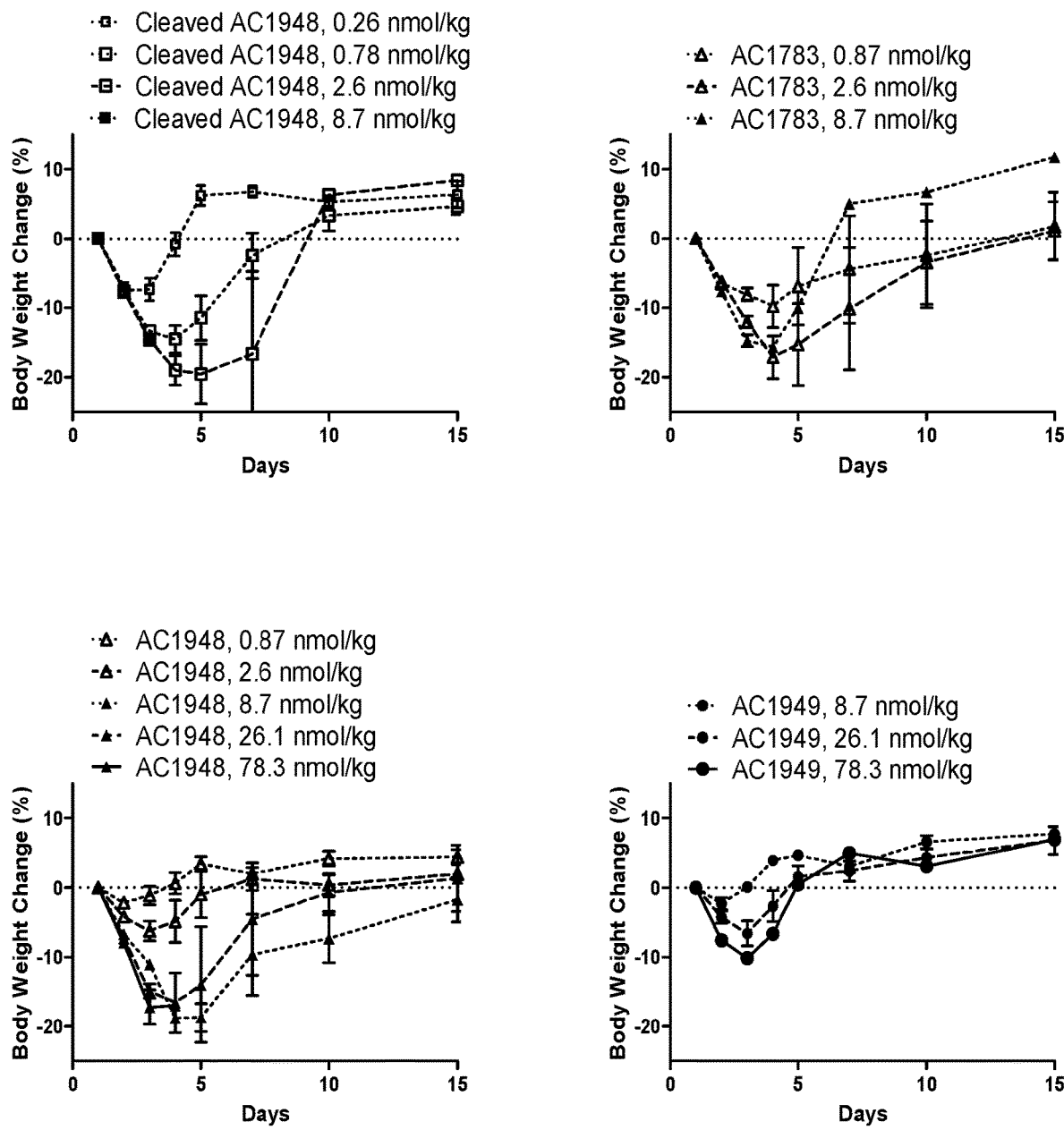
FIG. 78 shows results of body weight determinations in the treatment groups, as described in Example 57.

Results: One out of five mice treated with 0.87 or 2.6 nmol/kg of AC1783 and four out of five mice treated with 8.7 nmol/kg of AC1783 died by the fourth day post-treatment. One two of five mice treated with 8.7 nmol/kg, 3 out of 5 mice treated with 26.1 nmol/kg, and all five mice treated with 78.3 nmol/kg of AC1948 died by the seventh, fourth, and third day post-treatment, respectively. One out of five mice treated with 0.26 nmol/kg, three out of five mice treated with 2.6 nmol/kg, and all five mice treated with 8.7 nmol/kg of protease cleaved AC1948 died by the fourth day post-treatment. One out of five mice treated with 78.3 nmol/kg of non-cleavable AC1949 died by the fourth day post-treatment. Dose-dependent body weight loss was observed for each test article (FIG. 78). The data observed indicate an MTD for non-cleaved AC1783 less than 0.87 nmol/kg, for non-cleaved AC1948 between 2.6 and 8.7 nmol/kg, for cleaved AC1948 less than 0.26 nmol/kg, and for non-cleavable AC1949 between 26.1 and 78.3 nmol/kg.

Conclusions: Toxicity of anti-human EpCAM×anti-mouse CD3 ProTIA constructs, as assessed by body weight loss and death after a single dose, indicates that two XTEN masks the in vivo activity, as observed by at least a 100-fold increase in MTD for non-cleavable AC1949 compared to cleaved AC1948. The non-cleaved AC1948 has at least a 10-fold increase in MTD compared to cleaved AC1948, suggesting that only a fraction of AC1948 is cleaved in vivo in the Tg(TACSTD1)02Leij/J transgenic mice.

Example 58: Determination of the Maximum Tolerated Dose of Anti-Mouse EpCAM×Anti-Mouse CD3 Protease Triggered Immune Activator (ProTIA) Composition in BALB/c Mice Toxicity of ProTIA constructs was assessed in BALB/c mice using a surrogate molecule that binds to mouse EpCAM and mouse CD3 proteins. Several studies were performed using test articles with one XTEN and release segment sequences of varying rates.

Test articles were dosed at levels between 0.87 and 78.3 nmol/kg (with 3, 4, or 5 mice per group), and health and body weight of the mice were monitored for 14 days post-dosing.

Results: Table 21 shows a summary of the results, with differences in toxicity, as observed by body weight loss and death, depending on the rate and protease inclusivity of the release segment sequence.

Conclusions: Toxicity of anti-mouse EpCAM×anti-mouse CD3 ProTIA constructs, as assessed by body weight loss and death after a single dose, indicates that XTEN masks the in vivo activity, as observed by a 90-fold increase in MTD for non-cleavable AC1867 compared to cleaved AC1696. Depending on the release segment, the non-cleaved one XTEN ProTIA constructs have 10- to 90-fold increases in MTD compared to cleaved AC1696, demonstrating that the protease included in and rate of the release segment affect the in vivo activity.

TABLE 21

In vivo determination of MTD of anti-mouse EpCAM × anti-mouse CD3 variants in BALB/c mice

| ProTIA | Release Segment | Dose (nmol/kg) | | | | |
|---|---|---|---|---|---|---|
| | | 0.87 | 2.6 | 8.7 | 26.1 | 78.3 |
| cleaved AC1696 | cleaved RSR-2089 | 40 | D | D | | |
| AC1696 | RSR-2089 | | | D | D | |
| AC1598 | RSR-2295 | | N | 80 | D | |
| AC1677 | RSR-2298 | | | D | | |
| AC1712 | RSR-2485 | | N | N | 20 | |
| AC1713 | RSR-2486 | | N | 20 | D | |
| AC1690 | RSR-2488 | | N | 67 | 60 | |
| AC1710 | RSR-2599 | | N | N | 20 | |
| AC1867 | RSR-3058 | | | N | N | 40 |
| AC1868 | RSR-2783 | | | N | N | 20 |
| AC1870 | RSR-2789 | | | N | 100 | |
| AC1822 | RSR-2486 | | N | N | D | D |
| AC1993 | RSR-3103 | | | N | N | 40 |
| AC1995 | RSR-3119 | | | N | N | 20 |
| AC1997 | RSR-3114 | | | N | 60 | D |
| AC1999 | RSR-3126 | | | N | 25 | D |
| AC2000 | RSR-3127 | | | N | N | 40 |

N = no mice observed with body weight loss greater than 10%
D = death observed
number = percentage of mice with body weight loss greater than 10%

Example 59: Binding Affinity of Anti-EpCAM×Anti-CD3 Protease Triggered Immune Activator (ProTIA) Composition The binding affinity of anti-EpCAM×anti-CD3 ProTIA constructs to human EpCAM and human CD3 was measured using flow cytometry with huEp-CHO 4-12B (CHO cell line transfected with human EpCAM) and Jurkat cells.

The binding constants for anti-EpCAM×anti-CD3 ProTIA binding to EpCAM-expressing and CD3-expressing cells was measured by competition binding with a fluorescently-labeled, protease-treated ProTIA. The fluorescently-labeled, protease-treated ProTIA was made by conjugation of Alexa Fluor 647 C2 maleimide (Thermo Fisher, cat #A20347) to a cysteine-containing, protease-treated ProTIA mutant (MMP-9 treated AC1531). Binding experiments were performed on 10,000 cells at 4° C. for 1 hour in a total volume of 100 microL of binding buffer (2% FCS, 5 mM EDTA, HBSS). Cells were washed once with cold binding buffer, then re-suspended in 2% formaldehyde in phosphate-buffered saline and immediately analyzed on a Millipore Guava easyCyte flow cytometer. Binding of the fluorescently-labeled, protease-treated AC1531 was found to have an apparent $K_d$ value of 1 nM to hEp-CHO 4-12B and 6 nM to CD3+ Jurkat cells.

Competition binding experiments were performed on 10,000 hEp-CHO 4-12B cells with 1.5 nM fluorescently-labeled, protease-treated AC1531 at 4° C. for 1 hour in a total volume of 100 microL of binding buffer (2% FCS, 5 mM EDTA, HBSS). Cells were washed once with cold binding buffer, then re-suspended in 2% formaldehyde in phosphate-buffered saline and immediately analyzed on a Millipore Guava easyCyte flow cytometer.

Results of the binding assays are summarized in Table 22. Competition binding of fluorescently-labeled, protease-treated AC1531 to hEp-CHO 4-12B cells with cleaved ProTIA resulted in apparent binding constants of 0.5-0.8 nM for hEp.2, whereas uncleaved ProTIA with a single XTEN showed weaker hEp.2 binding constants (6.1 to 8.9 nM) and uncleaved ProTIA with two XTENs showed the weakest hEp.2 binding constant (100 nM).

Competition binding experiments were performed on 10,000 Jurkat cells with 10 nM fluorescently-labeled, protease-treated AC1531 at 4° C. for 1 hour in a total volume of 100 microL of binding buffer (2% FCS, 5 mM EDTA, HBSS). Cells were washed once with cold binding buffer, then re-suspended in 2% formaldehyde in phosphate-buffered saline and immediately analyzed on a Millipore Guava easyCyte flow cytometer. Competition binding of fluorescently-labeled, protease-treated AC1531 to Jurkat cells with cleaved ProTIA resulted in apparent binding constants of 12 nM for hCD3.3 (Table 22), whereas ProTIA with a single XTEN showed weaker hCD3.3 binding constants (128 to 158 nM) and ProTIA with two XTENs showed the weakest hCD3.3 binding constant (412 nM). Competition binding of fluorescently-labeled, protease-treated AC1531 to Jurkat cells with cleaved ProTIA resulted in apparent binding constants of 75 nM for hCD3.9, whereas ProTIA with a single XTEN showed weaker hCD3.9 binding constants (370 nM) and ProTIA with two XTENs showed the weakest hCD3.9 binding constant (930 nM).

Conclusions: The shielding of anti-EpCAM×anti-CD3 ProTIA constructs by one XTEN (AC1703 and AC1968) weakened the binding affinity to human EpCAM on hEp-CHO 4-12B cells by about 10-fold compared to cleaved constructs (cleaved AC1695 and cleaved AC1968). ProTIA with two XTEN decreased the binding affinities by about 100-fold (AC1886 and AC1952 compared to cleaved AC1695 and cleaved AC1968, respectively). The shielding of anti-EpCAM×anti-CD3.3 ProTIA constructs by one XTEN (AC1703) weakened the binding affinity to human CD3 on Jurkat cells by about 10-fold compared to cleaved AC1695, whereas the shielding of anti-EpCAM×anti-CD3.9 ProTIA constructs by one XTEN (AC1968) weakened the binding affinity to human CD3 on Jurkat cells by about 5-fold compared to cleaved AC1968. ProTIA with two XTEN decreased the binding affinities by about 30-fold for CD3.3 and 10-fold for CD3.9 (AC1886 compared to cleaved AC1695, and AC1952 compared to cleaved AC1968, respectively). Overall the data demonstrates that one XTEN shields both the anti-EpCAM and anti-CD3 domains of ProTIA, and two XTEN further shield both domains.

TABLE 22

Binding constants of anti-human EpCAM × anti-human CD3 variants by competition binding to hEp-CHO 4-12B or Jurkat cells

| ProTIA | Release Segment | Apparent Binding Constant (nM) | |
|---|---|---|---|
| | | hEp-CHO 4-12B | Jurkat |
| cleaved AC1695 | cleaved RSR-2089 | 0.8 | 12 |
| AC1703 | RSR-3058 | 8.9 | 128 |
| AC1878 | RSR-3058 | 4.6 | 158 |
| AC1886 | RSR-3058 | 100 | 412 |
| cleaved AC1968 | cleaved RSR-2295 | 0.5 | 75 |
| AC1968 | RSR-2295 | 6.1 | 370 |
| AC1953 | RSR-2295 | 6.8 | |
| cleaved AC1952 | cleaved RSR-2295 | | 78 |
| AC1952 | RSR-2295 | 52 | 930 |

Example 60: Anti-Tumor Properties of Anti-EpCAM×Anti-CD3 Protease Triggered Immune Activator (ProTIA) Bearing Different Release Site Composition in Established Breast Tumor Model In the established breast tumor model, BT-474 tumor cells were independently implanted, in the presence of matrigel, subcutaneously into NOG (NOD/Shi-scid/IL-2Rγ$^{null}$) or NSG (NOD.Cg-Prkdc$^{scid}$.IL2rg$^{tm1Wjl}$/SzJ) mice on day 0. (The NOG or NSG mice are NOD/SCID mice bearing IL-2Ry mutation resulting in the mice lacking T, B and NK cells, dysfunctional macrophage, dysfunctional dendritic cells and reduced complement activity.) Human PBMCs were then intravenously introduced when BT-474 tumor volume reached 100-200 mm$^3$. Treatment with vehicle, protease-untreated anti-EpCAM×anti-CD3 ProTIA carrying different release site composition (e.g. AC1714, AC1684 and AC1686) and an anti-Her2×anti-CD3 ProTIA (e.g. AC1503) as a positive control was initiated as three intravenous doses per week for four weeks. Cohort 1 was the vehicle-treated group. Cohort 2 and 3 were the AC1714-treated groups dosed at 0.1 mg/kg and 0.5 mg/kg respectively. Cohort 4 and 5 were the AC1684-treated groups dosed at 0.1 mg/kg and 0.5 mg/kg respectively. Cohort 6 was the AC1686-treated group dosed at 0.1 mg/kg; and cohort 7 was the anti-Her2×anti-CD3 positive control ProTIA (AC1503) dosed at 0.5 mg/kg.

Tumors were measured twice per week for a projected 45 days with a caliper in two perpendicular dimensions and tumor volumes were calculated by applying the (width$^2$× length)/2 formula. Body weight, general appearance and clinical observations such as seizures, tremors, lethargy, hyper-reactivity, pilo-erection, labored/rapid breathing, coloration and ulceration of tumor and death were also closely monitored as a measure of treatment related toxicity. Percent tumor growth inhibition index (% TGI) was calculated for each of the treatment group by applying the formula: ((Mean tumor volume of Group 2 vehicle control−Mean tumor volume of ProTIA treatment)/mean tumor volume of Group 2 vehicle control)×100. A treatment result with a % TGI≥60% was considered therapeutically active.

Results: Tumor volume data are depicted in FIGS. 79A and 79B. At day 45, vehicle-treated cohort 1 mice did not inhibit tumor progression having a tumor burden of 410±215 mm$^3$, demonstrating that human effector cells alone as such could not elicit an anti-tumor effect. As expected, treatment with the anti-Her2×anti-CD3 positive control ProTIA at 0.5 mg/kg (AC1503, cohort 7) in the presence of human effector cells exhibited clear anti-tumor regression with a % TGI of 95%. Treatment with the AC1714 anti-EpCAM×anti-CD3 ProTIA at 0.1 mg/kg and 0.5 mg/kg (cohort 2 and 3 respectively) in the presence of human effector cells inhibited tumor growth in a dose-dependent manner. At 0.5 mg/kg, AC1714 was therapeutically active with % TGI of 94%; and therapeutically inactive at 0.1 mg/kg with a % TGI of 50%. AC1684, bearing a different release segment compared to AC1714, was therapeutically inactive at 0.1 mg/kg (% TGI 34%) as well as 0.5 mg/kg (% TGI 41%). AC1686 dosed at 0.1 mg/kg was also observed not to be therapeutically active (% TGI 41%).

Conclusions: The data suggest that at 0.5 mg/kg, sufficient AC1714 anti-EpCAM×anti-CD3 ProTIA was effectively cleaved by proteases in the in vivo BT-474 tumor environment to the more active, unXTENylated anti-EpCAM×anti-CD3 moiety to yield the observed robust anti-tumor response. AC1684 and AC1686 are both much less effective as compared to AC1714 in yielding active anti-EpCAM× anti-CD3 moiety in BT-474 to elicit any significant efficacy.

Example 61: In Vitro Caspase 3/7 Assay of Anti-EGFR×Anti-CD3 Protease Triggered Immune Activator (ProTIA) Composition Redirected cellular cytotoxicity of protease-untreated anti-EGFR×anti-CD3 ProTIA compositions (e.g. AC1955 and AC1958) compared to protease-treated anti-EGFR×anti-CD3 ProTIA and protease-non-cleavable (e.g. AC1991) was assessed in an in vitro cell-based assay of caspase 3/7 activities of apoptotic cells. Similar to the caspase cytotoxicity assay described in the Examples, above, PBMC were mixed with EGFR positive tumor target cells in a ratio of 10 effector cells to 1 target cell and incubated at 37° C./5% $CO_2$ for either 24h or 48 h. All ProTIA variants were tested using a 12-point, 5× serial dilution of dose concentrations. Human tumor target cell lines assayed were FaDu (squamous cell carcinoma of the head and neck, SCCHN), SCC-9 (SCCHN), HCT-116 (colorectal bearing KRAS mutation), NCI-H1573 (colorectal bearing KRAS mutation), HT-29 (colorectal bearing BRAF mutation) and NCI-H1975 (EGFR T790M mutation). The cell lines were selected to represent colorectal and SCCHN tumors with wild type EGFR and T790M, KRAF and BRAF mutations.

Upon cell lysis, released caspase 3/7 in culture supernatants was measured by the amount of luminogenic caspase 3/7 substrate cleavage by caspase 3/7 to generate the "glow-type" luminescent signal (Promega Caspase-Glo 3/7 cat #G8091). The amount of luminescence is proportional to the amount of caspase activities.

Results: Results of the assays are depicted in FIGS. 80A and B and Table 23. When evaluated in EGFR KRAS mutant HCT-116 cell line, the $EC_{50}$ activity of the protease-untreated ProTIA variant AC1955 was 3,408 pM and AC1958 was 778 pM. The non-cleavable ProTIA AC1991 $EC_{50}$ activity was >100,000 pM and the protease-cleaved ProTIA $EC_{50}$ activity was 0.8 pM.

When evaluated in EGFR BRAF mutant HT-29 cell line, the $EC_{50}$ activity of the protease-untreated ProTIA variant AC1955 was 10,930 pM and the $EC_{50}$ activity AC1958 was 12,100 pM. The $EC_{50}$ activity of the non-cleavable ProTIA AC1991 was >100,000 pM and the $EC_{50}$ activity of the protease-cleaved ProTIA was 0.8 pM.

The two protease-untreated ProTIA variants (e.g. AC1955 and AC1958) had a 4-fold difference in activity in HCT-116 and similar activity in HT-29. However, both variants were >1,000 to 15,000-fold less active than the cleaved anti-EGFR×anti-CD3 ProTIA in the two EGFR mutant cell lines tested. As expected, the activity of the non-cleavable ProTIA (AC1991) was the least active of the PoTIA versions evaluated with $EC_{50}$ of greater than 100,000 pM.

Conclusions: The results demonstrated that anti-EGFR× anti-CD3 ProTIA are cytotoxically active against EGFR KRAS- and BRAF-mutant cell lines. Uncleaved anti-EGFR×anti-CD3 ProTIAs bearing two XTEN (e.g. AC1955) offered strong masking of cytotoxicity activity of 4000- to 14,000-fold less cytotoxicity compared to the cleaved form.

TABLE 23

In vitro cytotoxicity activity of protease-treated, protease-untreated and protease-non-cleavable anti-EGFR × anti-CD3 variants in HT-29 and HCT-116 human cell lines

| ProTIA | EC50 (pM) | |
|---|---|---|
| | HCT-116 | HT-29 |
| Protease-treated AC1955 | 0.8 | 0.8 |
| Protease-untreated AC1955 | 3408 | 10930 |
| Protease-untreated AC1958 | 778 | 12100 |
| Protease-non-cleavable AC1991 | >100000 | >100000 |

Example 62: In Vitro Caspase 3/7 Assay of Anti-Her2×Anti-CD3 Protease Triggered Immune Activator (ProTIA) Composition Redirected cellular cytotoxicity of protease-untreated anti-Her2×anti-CD3 ProTIA compositions (e.g. AC2038 and AC2040) compared to protease-treated anti-Her2×anti-CD3 ProTIA and protease-non-cleavable (e.g. AC2039) was assessed in an in vitro cell-based assay of caspase 3/7 activities of apoptotic cells. Similar to the caspase cytotoxicity assays described above, PBMC were mixed with Her2 positive tumor target cells in a ratio of 5 effector cells to 1 target cell and incubated at 37° C./5% $CO_2$ for 24 h. All ProTIA variants were tested using a 12-point, 5× serial dilution of dose concentrations as in the caspase assay described above. Human Her2-expressing breast tumor cell lines used in the assay were BT-474, SK-BR-3, JIMT-1, T-47D, ZR-75-1, MCF-7, MBA-MB-231, human Her2-expressing ovarian tumor cell line SK-OV-3, human Her2-expressing gastric tumor cell lines NCI-N87, MNK7, SNU-216, NUGC-4, and human Her2-expressing bladder cell line such as RT-112. The cell lines were selected to not only represent different cancer types but also different levels of Her2-expression per cell with BT-474, SK-OV-3, SK-BR-3, NCI-N87 and MNK7 expressing high level of Her2; JIMT-1, SNU-216, NUGC-4 and RT-112 expressing mid-level of Her2; and T-47D, ZR-75-1, MCF-7, MDA-MB-231 expressing low to zero level of Her2.

Upon cell lysis, released caspase 3/7 in culture supernatants was measured by the amount of luminogenic caspase 3/7 substrate cleavage by caspase 3/7 to generate the "glow-type" luminescent signal (Promega Caspase-Glo 3/7 cat #G8091). The amount of luminescence is proportional to the amount of caspase activities.

Results: Results of the assays are depicted in FIGS. 81A-D and Table 24. When evaluated in Her2 high BT-474 cell line, the $EC_{50}$ activity of the protease-untreated ProTIA variant AC2038 and AC2040 was 66,020 pM and 7,729 pM respectively. In comparison, the $EC_{50}$ activity of protease-treated AC2038 was 1.5 pM and the $EC_{50}$ activity of non-cleavable ProTIA (e.g. AC2039) was >100,000 pM.

When evaluated in Her2 high SK-OV-3 cell line, the $EC_{50}$ activity of the protease-untreated ProTIA variant AC2038 and AC2040 was 14,140 pM and 6,127 pM respectively. In comparison, the $EC_{50}$ activity of protease-treated AC2038 was 1 pM and the $EC_{50}$ activity of non-cleavable ProTIA (e.g. AC2039) was >100,000 pM.

When evaluated in Her2 mid JIMT-1 cell line, the $EC_{50}$ activity of the protease-treated AC2038 was 52 pM, compared to an $EC_{50}$ activity of >100,000 pM for the protease-untreated AC2038 and AC2040 and the non-cleavable ProTIA AC2039.

When evaluated in Her2 low MDA-MB-231 cell line, the $EC_{50}$ activity of the protease-treated AC2038 was 124 pM as compared to an $EC_{50}$ activity of >100,000 pM for protease-untreated AC2038 and AC2040 and the non-cleavable ProTIA AC2039.

Comparison of the two protease-untreated anti-Her2× anti-CD3 ProTIA variants AC2038 and AC2040 was assayed in Her2-high expressing cell lines such as SK-OV-3 and BT-474. The difference in $EC_{50}$ activity between the two variants was only 2-fold to 9-fold. Significantly, both ProTIA variants were 440 to 14,000-fold less active than the cleaved anti-Her2×anti-CD3 ProTIA in the BT-474 and SK-OV-3 cell lines tested. As expected, the activity of the non-cleavable ProTIA AC2039 was the least active of the PoTIA versions evaluated with an $EC_{50}$ greater than 100,000 pM.

Conclusions: The results demonstrated that while protease-treated anti-Her2×anti-CD3 ProTIA was highly active, with a robust magnitude of killing in Her2-high- and Her2-mid expressing cell lines, the activity and magnitude of killing was poorer in Her2 low-expressing cell lines. In line with the activity trend of the protease-untreated ProTIA profiled above, anti-Her2×anti-CD3 ProTIAs bearing two XTEN (e.g. AC2038) offered strong masking of cytotoxicity activity, with a reduced $EC_{50}$ activity of at least greater than 14,000-fold.

TABLE 24

In vitro cytotoxicity activity of protease-treated, protease-untreated and protease-non-cleavable anti-Her2 x anti-CD3 variants in BT-474, SK-OV-3, JIMT-1 and MDA-MB-231 human cell lines

| ProTIA | EC50 (pM) | | | |
|---|---|---|---|---|
| | BT-474 Her2 high | SK-OV-3 Her2 high | JIMT-1 Her2 mid | MDA-MB-231 Her2 low |
| Protease-treated AC2038 | 1.5 | 1 | 52 | ~124 |
| Protease-untreated AC2038 | 66020 | 14140 | >100000 | >100000 |
| Protease-untreated AC2040 | 7726 | 6127 | >100000 | >100000 |
| Protease-non-cleavable AC2039 | >100000 | >100000 | >100000 | >100000 |

Example 63: Anti-Tumor Properties of Anti-EGFR×Anti-CD3 Protease Triggered Immune Activator (ProTIA) Composition in Early Treatment HT-29 In Vivo Model An in vivo efficacy experiment was performed in immunodeficient NOD/SCID mice, characterized by the deficiency of T and B cells and impaired natural killer cells. Mice were maintained in sterile, standardized environmental conditions and the experiment was performed in accordance with US Institutional Animal Care Association for Assessment and Use Committee (IACUC Accreditation of Laboratory Animal Care (AAALAC)) guidelines. The efficacy of protease-treated and protease-untreated anti-EGFR×anti-CD3 ProTIA (e.g. AC1955) was evaluated using the EGFR BRAF mutant human HT-29 adenocarcinoma xenograft model. Briefly, on day 0, 6 NOD/SCID mice were subcutaneously implanted in the right flank with $3 \times 10^6$ HT-29 cells per mouse (Cohort 1). On the same day, cohort 2 to 7 each consisting of 6 NOD/SCID mice per group were subcutaneously injected in the right flank with a mixture of $6 \times 10^6$ human PBMC and $3 \times 10^6$ HT-29 cells per mouse. Four hours after HT-29 or HT-29/PBMC mixture inoculation, treatments were initiated. Cohort 1 and 2 were injected intravenously] with vehicle (PBS+0.05% Tween 80), cohort 3 and 4 were injected with 0.05 mg/kg and 0.5 mg/kg protease-treated anti-EGFR×anti-CD3 ProTIA respectively, cohort 5 and 6 were injected with 0.143 mg/kg and 1.43 mg/kg protease-untreated anti-EGFR×anti-CD3 ProTIA, and cohort 7 with injected with 50 mg/kg Cetuximab. Cohorts 1 to 6 further received seven additional doses administered daily from day 1 to day 7 (total 8 doses). Cohort 7 was dosed with cetuximab twice/week for 4 weeks for a total of 8 doses.

Tumors were measured twice per week for a projected 33 days with a caliper in two perpendicular dimensions and tumor volumes were calculated by applying the (width$^2$× length)/2 formula. Body weight, general appearance and clinical observations such as seizures, tremors, lethargy, hyper-reactivity, pilo-erection, labored/rapid breathing, coloration and ulceration of tumor and death were also closely monitored as a measure of treatment related toxicity. Percent tumor growth inhibition index (% TGI) was calculated for each of the treatment group by applying the formula: ((Mean tumor volume of Group 2 vehicle control−Mean tumor volume of ProTIA treatment)/mean tumor volume of Group 2 vehicle control)×100. Treatment results with a % TGI≥60% is considered therapeutically active.

Results: Results are depicted in FIGS. 82A and B. At day 33, vehicle-treated cohort 1 mice bearing tumor cells only had a tumor burden of 250±113 mm$^3$. Cohort 2 mice treated with vehicle in the presence of human effector cells did not inhibit tumor progression, having a tumor burden of 238±228 mm$^3$, demonstrating that human effector cells alone as such could not elicit an anti-tumor effect. Treatment with the protease-treated anti-EGFR×anti-CD3 ProTIA at 0.05 mg/kg and 0.5 mg/kg (cohort 3 and 4 respectively) in the presence of human effector cells exhibited clear anti-tumor regression with a % TGI of 99% for both. Importantly, treatment with anti-EGRF×anti-CD3 ProTIA at 0.143 mg/kg and 1.43 mg/kg (cohort 5 and 6 respectively) in the presence of human effector cells also inhibited tumor growth in a dose-dependent manner with % TGI of 70% for the 0.143 mg/kg dose group and 96% in the 1.43 mg/kg cohort. The data suggest that at 0.143 mg/kg and 1.43 mg/kg, sufficient amounts of anti-EGRF×anti-CD3 ProTIAs were effectively cleaved by proteases in the in vivo tumor environment into the more active, unXTENylated anti-EGFR×anti-CD3 moiety to yield the observed efficacy. Significantly, cohort 7 treated with 50 mg/kg of cetuximab did not induce tumor regression with a % TGI of −20%.

Conclusions: The results suggest that protease-untreated anti-EGFR×anti-CD3 ProTIA (e.g. AC1955) can be effectively cleaved and is efficacious in the EGFR BRAF mutant HT-29 tumor environment to inhibit tumor progression. In addition, protease-untreated anti-EGFR×anti-CD3 ProTIA is superior to cetuximab in anti-tumor activity. Of note, no significant body weight loss was observed in all ProTIA treatment groups and vehicle control indicating that all treatments were well tolerated.

Example 64: Anti-Tumor Properties of Anti-EpCAM×Anti-CD3 Protease Triggered Immune Activator (ProTIA) Bearing One or Two XTEN in Established Breast Tumor Model In the established breast tumor model, BT-474 tumor cells were independently implanted, in the presence of matrigel, subcutaneously into NOG (NOD/Shi-scid/IL-2Rγ$^{null}$) or NSG (NOD.Cg-Prkdc$^{scid}$.IL2rg$^{tm1Wjl}$/SzJ) mice on day 0. (The NOG or NSG mice are NOD/SCID mice bearing IL-2Rγ mutation resulting in the mice lacking T, B and NK cells, dysfunctional macrophage, dysfunctional dendritic cells and reduced complement activity.) Human PBMCs were then intravenously introduced when BT-474 tumor volume reached 100-200 mm$^3$. Treatment with vehicle, protease-untreated anti-EpCAM×anti-CD3 ProTIA carrying one XTEN polymer (e.g. AC1968) and an anti-EpCAM× anti-CD3 ProTIA bearing two XTEN polymers (e.g. AC1952) was initiated intravenously as three doses per week for four weeks. Cohort 1 was the vehicle-treated group, cohort 2 was the AC1968-treated group at 0.5 mg/kg, and cohort 3 was the AC1952-treated group at 0.5 mg/kg.

Tumors were measured twice per week for a projected 45 days with a caliper in two perpendicular dimensions and tumor volumes were calculated by applying the (width$^2$× length)/2 formula. Body weight, general appearance and clinical observations such as seizures, tremors, lethargy, hyper-reactivity, pilo-erection, labored/rapid breathing, coloration and ulceration of tumor and death were also closely monitored as a measure of treatment related toxicity. Percent tumor growth inhibition index (% TGI) was calculated for each of the treatment group by applying the formula: ((Mean tumor volume of Group 2 vehicle control−Mean tumor volume of ProTIA treatment)/mean tumor volume of Group 2 vehicle control)×100. Treatment group with % TGI≥60% is considered therapeutically active.

Results: Results are depicted in FIGS. 83A and B. At interim day 27, vehicle-treated cohort 1 mice did not inhibit tumor progression having a tumor burden of 219±30 mm$^3$, demonstrating that human effector cells alone as such could not elicit an anti-tumor effect. As expected, treatment with AC1968 anti-EpCAM×anti-CD3 ProTIA at 0.5 mg/kg (cohort 2) in the presence of human effector cells exhibited clear anti-tumor regression with % TGI of 68%. Importantly, treatment with AC1952 anti-EpCAM×anti-CD3 ProTIA at 0.5 mg/kg (cohort 3) in the presence of human effector cells also elicited a robust anti-tumor response yielding a % TGI of 76%.

Conclusions: Interim data suggest that at 0.5 mg/kg in the in vivo BT-474 tumor environment, protease-untreated anti-EpCAM×anti-CD3 ProTIA bearing two XTENs (e.g., AC1952) is as efficacious as protease-untreated anti-Ep-CAM×anti-CD3 ProTIA bearing one XTEN polymer (e.g., AC1968). Of note, no significant body weight loss was observed in all ProTIA treatment groups and vehicle control indicating that all treatments were well tolerated.

Example 65: Single- and Multi-Dose Pharmacokinetic Determination of Anti-EGFR×Anti-CD3 ProTIA in Non-Human Primates The pharmacokinetics (PK) and general tolerability of anti-EGFR×anti-CD3 ProTIA (e.g., AC1955) following single and multiple intravenous administrations will be evaluated in naïve, healthy non-human primates (NHP) (e.g., cynomolgus monkeys). Briefly, one female and one male monkey is intravenously infused with via the cephalic vein. Both animals will be monitored for two weeks. When no adverse events are observed, animals will be subjected to a multi-dose regimen initiated as one dose every three days for three weeks (total 9 doses in study). At specific time points throughout the study, blood will be collected for assay of pharmacokinetics, cytokines, hematology and serum chemistries.

Animal monitoring will include body weight, food consumption, body temperature and cage-side observations once or twice daily during the duration of the study. Animals will be monitored for general health and appearance; signs of pain and distress; fever, chills, nauseas, vomiting and skin integrity. On dosing days, animals will be checked for injection side reactions before and after ProTIA administration.

The amount of AC1955 present in plasma will be quantitated on a sandwich ELISA using EGFR-biotin captured on an electrochemiluminescence streptavidin plate with sulfo-tagged anti-XTEN-antibody as detection. Pharmacokinetic parameters including Cmax, Tmax, area under the curve, half-life and exposure profile will be analyzed using the WinNonLin software.

The cytokine panel includes measurement of IFN-γ, IL-1β, IL-2, IL-4, IL-6, IL-10 and TNFα using the Meso-Scale Discovery platform.

The hematology panel includes measurement of white blood cells, red blood cells, hemoglobin, hematocrit, mean corpuscular hemoglobin volume, mean corpuscular hemoglobin concentration, red blood cell distribution width, platelet, mean platelet volume, % neutrophils, % lymphocytes, % monocytes, % eosinophils and % basophils.

The serum chemistry panel includes measurement of alanine aminotransferase, aspartate aminotransferase, total protein, albumin, alkaline phosphatase, globulin, albumin/globulin ratio, γ-glutamyltransferase, glucose, urea, creatinine, calcium, total cholesterol, triglycerides, total bilirubin, sodium, potassium, chlorine and creatine kinase.

It is expected that AC1955 will not elicit any adverse events at a dose of 1.7 µg/kg. No cytokine syndrome, chills, fever, nausea, vomiting and skin rash are expected. Hematology and clinical panel should be within normal range. Based on historical data of XTENylated proteins, AC1955 is anticipated to have a $T_{1/2}$ of 3-5 days.

Example 66: Dose Range Finding of Anti-EGFR×Anti-CD3 in Non-Human Primates

The maximum tolerated dose of AC1955 in NHP will be carried out in healthy, naïve cynomolgus monkeys with one female and one male monkey per cohort. Cohort 1 will be intravenously infused with 25.5 µg/kg of AC1955 via the cephalic vein. Both monkeys will be monitored for a week. When no adverse events such as fever, chills, skin rash, nausea, vomiting, abnormal hematology and serum chemistry are observed, animals will be subjected to a multi-dose regimen initiated as two doses per week for 3 weeks (total 7 doses per cohort). At specific time, blood will be drawn for pharmacokinetics, cytokines, immune contexture, hematology and serum chemistry analyses.

When no adverse events are observed one week after the first dose in Cohort 1, AC1955 will be dose escalated 3-fold to 76.5 mg/kg in Cohort 2. The dosing regimen, monitoring and blood collection of Cohort 2 will be similar to that of Cohort 1. When no adverse events are observed one week after the first dose in Cohort 2, AC1955 will be dose escalated another 3-fold to 230 µg/kg in Cohort 3. The three-fold dose escalation of AC1955 will proceed until adverse events are observed.

Animal monitoring will include body weight, food consumption, body temperature and cage-side observations once or twice daily during the duration of the study. Animals will be monitored for general health and appearance; signs of pain and distress; fever, chills, nauseas, vomiting and skin integrity. On dosing days, animals will also be checked for injection site reaction before and after ProTIA administration.

The amount of AC1955 present in plasma will be quantitated on a sandwich ELISA using EGFR-biotin captured on an electrochemiluminescence streptavidin plate with sulfo-tagged anti-XTEN-antibody as detection. Pharmacokinetic parameters including Cmax, Tmax, area under the curve, half-life and exposure profile will be analyzed using WinNonLin software.

The cytokine panel includes measurement of IL-2, IL-4, IL-5, IL-6, IL-10, IL-13, IFN-γ and TNFα using Beckon Dickinson Cytometric Bead Array.

The immune contexture includes measurement of CD3, CD4, CD8, CD16, CD20, CD25, CD45, CD69, Foxp3 and PD-1.

The hematology panel includes measurement of white blood cells, red blood cells, hemoglobin, hematocrit, mean corpuscular hemoglobin volume, mean corpuscular hemoglobin concentration, red blood cell distribution width, platelet, mean platelet volume, % neutrophils, % lymphocytes, % monocytes, % eosinophils and % basophils.

The serum chemistry panel includes measurement of alanine aminotransferase, aspartate aminotransferase, total protein, albumin, alkaline phosphatase, globulin, albumin/globulin ratio, γ-glutamyltransferase, glucose, urea, creatinine, calcium, total cholesterol, triglycerides, total bilirubin, sodium, potassium, chlorine and creatine kinase.

It is expected that AC1955 will hit a maximum tolerated dose at one of the dose levels eliciting some adverse events. The anticipated adverse events could be one or a combination of chills, fever, nausea, vomiting, skin rash, and abnormal hematology and chemistry readings, spiked in cytokines.

SEQUENCE LISTING (1027 sequences)

SEQ ID NO: 1 - protein, 16 aa, Artificial Sequence
  Description of Artificial Sequence: Synthetic peptide
EAGRSANHEPLGLVAT

SEQ ID NO: 2 - protein, 16 aa, Artificial Sequence
  Description of Artificial Sequence: Synthetic peptide
ASGRSTNAGPSGLAGP

SEQ ID NO: 3 - protein, 16 aa, Artificial Sequence
  Description of Artificial Sequence: Synthetic peptide
ASGRSTNAGPQGLAGQ

SEQ ID NO: 4 - protein, 16 aa, Artificial Sequence
  Description of Artificial Sequence: Synthetic peptide
ASGRSTNAGPPGLTGP

SEQ ID NO: 5 - protein, 16 aa, Artificial Sequence
  Description of Artificial Sequence: Synthetic peptide
ASSRGTNAGPAGLTGP

SEQ ID NO: 6 - protein, 16 aa, Artificial Sequence
  Description of Artificial Sequence: Synthetic peptide
ASSRTTNTGPSTLTGP

SEQ ID NO: 7 - protein, 16 aa, Artificial Sequence
  Description of Artificial Sequence: Synthetic peptide
AAGRSDNGTPLELVAP

SEQ ID NO: 8 - protein, 16 aa, Artificial Sequence
  Description of Artificial Sequence: Synthetic peptide
ASGRGTNAGPAGLTGP

SEQ ID NO: 9 - protein, 16 aa, Artificial Sequence
  Description of Artificial Sequence: Synthetic peptide
LFGRNDNHEPLELGGG

SEQ ID NO: 10 - protein, 16 aa, Artificial Sequence
  Description of Artificial Sequence: Synthetic peptide
TAGRSDNLEPLGLVFG

SEQ ID NO: 11 - protein, 16 aa, Artificial Sequence
  Description of Artificial Sequence: Synthetic peptide
LDGRSDNFHPPELVAG

SEQ ID NO: 12 - protein, 16 aa, Artificial Sequence
  Description of Artificial Sequence: Synthetic peptide
LEGRSDNEEPENLVAG

SEQ ID NO: 13 - protein, 16 aa, Artificial Sequence
  Description of Artificial Sequence: Synthetic peptide
LKGRSDNNAPLALVAG

SEQ ID NO: 14 - protein, 16 aa, Artificial Sequence
  Description of Artificial Sequence: Synthetic peptide
VYSRGTNAGPHGLTGR

SEQ ID NO: 15 - protein, 16 aa, Artificial Sequence
  Description of Artificial Sequence: Synthetic peptide
ANSRGTNKGFAGLIGP

SEQ ID NO: 16 - protein, 16 aa, Artificial Sequence
  Description of Artificial Sequence: Synthetic peptide
ASSRLTNEAPAGLTIP

SEQ ID NO: 17 - protein, 16 aa, Artificial Sequence
  Description of Artificial Sequence: Synthetic peptide
DQSRGTNAGPEGLTDP

SEQ ID NO: 18 - protein, 16 aa, Artificial Sequence
  Description of Artificial Sequence: Synthetic peptide
ESSRGTNIGQGGLTGP

SEQ ID NO: 19 - protein, 16 aa, Artificial Sequence
  Description of Artificial Sequence: Synthetic peptide
SSSRGTNQDPAGLTIP

SEQ ID NO: 20 - protein, 16 aa, Artificial Sequence
  Description of Artificial Sequence: Synthetic peptide
ASSRGQNHSPMGLTGP

SEQ ID NO: 21 - protein, 16 aa, Artificial Sequence
  Description of Artificial Sequence: Synthetic peptide
AYSRGPNAGPAGLEGR

SEQ ID NO: 22 - protein, 16 aa, Artificial Sequence
  Description of Artificial Sequence: Synthetic peptide
ASERGNNAGPANLTGF

SEQ ID NO: 23 - protein, 16 aa, Artificial Sequence
  Description of Artificial Sequence: Synthetic peptide
ASHRGTNPKPAILTGP

SEQ ID NO: 24 - protein, 16 aa, Artificial Sequence
  Description of Artificial Sequence: Synthetic peptide
MSSRRTNANPAQLTGP

SEQ ID NO: 25 - protein, 16 aa, Artificial Sequence
  Description of Artificial Sequence: Synthetic peptide
GAGRTDNHEPLELGAA

SEQ ID NO: 26 - protein, 16 aa, Artificial Sequence
  Description of Artificial Sequence: Synthetic peptide
LAGRSENTAPLELTAG

SEQ ID NO: 27 - protein, 16 aa, Artificial Sequence
  Description of Artificial Sequence: Synthetic peptide
LEGRPDNHEPLALVAS

SEQ ID NO: 28 - protein, 16 aa, Artificial Sequence
  Description of Artificial Sequence: Synthetic peptide
LSGRSDNEEPLALPAG

SEQ ID NO: 29 - protein, 16 aa, Artificial Sequence
  Description of Artificial Sequence: Synthetic peptide
EAGRTDNHEPLELSAP

SEQ ID NO: 30 - protein, 16 aa, Artificial Sequence
  Description of Artificial Sequence: Synthetic peptide
EGGRSDNHGPLELVSG

SEQ ID NO: 31 - protein, 16 aa, Artificial Sequence
  Description of Artificial Sequence: Synthetic peptide
LSGRSDNEAPLELEAG

SEQ ID NO: 32 - protein, 16 aa, Artificial Sequence
  Description of Artificial Sequence: Synthetic peptide
LGGRADNHEPPELGAG

SEQ ID NO: 33 - protein, 16 aa, Artificial Sequence
  Description of Artificial Sequence: Synthetic peptide
PPSRGTNAEPAGLTGE

SEQ ID NO: 34 - protein, 16 aa, Artificial Sequence
  Description of Artificial Sequence: Synthetic peptide
ASTRGENAGPAGLEAP

SEQ ID NO: 35 - protein, 16 aa, Artificial Sequence
  Description of Artificial Sequence: Synthetic peptide
ESSRGTNGAPEGLTGP

SEQ ID NO: 36 - protein, 16 aa, Artificial Sequence
  Description of Artificial Sequence: Synthetic peptide
ASSRATNESPAGLTGE

SEQ ID NO: 37 - protein, 16 aa, Artificial Sequence
  Description of Artificial Sequence: Synthetic peptide
ASSRGENPPPGGLTGP

SEQ ID NO: 38 - protein, 16 aa, Artificial Sequence
  Description of Artificial Sequence: Synthetic peptide
AASRGTNTGPAELTGS

SEQ ID NO: 39 - protein, 16 aa, Artificial Sequence
  Description of Artificial Sequence: Synthetic peptide
AGSRTTNAGPGGLEGP

SEQ ID NO: 40 - protein, 16 aa, Artificial Sequence
  Description of Artificial Sequence: Synthetic peptide
APSRGENAGPATLTGA

SEQ ID NO: 41 - protein, 16 aa, Artificial Sequence
  Description of Artificial Sequence: Synthetic peptide
ESGRAANTGPPTLTAP

SEQ ID NO: 42 - protein, 16 aa, Artificial Sequence
  Description of Artificial Sequence: Synthetic peptide
NPGRAANEGPPGLPGS

SEQ ID NO: 43 - protein, 16 aa, Artificial Sequence
  Description of Artificial Sequence: Synthetic peptide
ESSRAANLTPPELTGP

SEQ ID NO: 44 - protein, 16 aa, Artificial Sequence
  Description of Artificial Sequence: Synthetic peptide
ASGRAANETPPGLTGA

SEQ ID NO: 45 - protein, 16 aa, Artificial Sequence
  Description of Artificial Sequence: Synthetic peptide
NSGRGENLGAPGLTGT

SEQ ID NO: 46 - protein, 16 aa, Artificial Sequence
  Description of Artificial Sequence: Synthetic peptide
TTGRAANLTPAGLTGP

SEQ ID NO: 47 - protein, 16 aa, Artificial Sequence
  Description of Artificial Sequence: Synthetic peptide
EAGRSANHTPAGLTGP

SEQ ID NO: 48 - protein, 16 aa, Artificial Sequence
  Description of Artificial Sequence: Synthetic peptide
ESGRAANTTPAGLTGP

SEQ ID NO: 49 - protein, 19 aa, Artificial Sequence
  Description of Artificial Sequence: Synthetic peptide
TTGRATEAANLTPAGLTGP

SEQ ID NO: 50 - protein, 19 aa, Artificial Sequence
  Description of Artificial Sequence: Synthetic peptide
TTGRAEEAANLTPAGLTGP

SEQ ID NO: 51 - protein, 19 aa, Artificial Sequence
  Description of Artificial Sequence: Synthetic peptide
TTGRAGEAANLTPAGLTGP

SEQ ID NO: 52 - protein, 19 aa, Artificial Sequence
  Description of Artificial Sequence: Synthetic peptide
TTGRATEAANATPAGLTGP

SEQ ID NO: 53 - protein, 19 aa, Artificial Sequence
  Description of Artificial Sequence: Synthetic peptide
TTGRAGEAEGATSAGATGP

SEQ ID NO: 54 - protein, 19 aa, Artificial Sequence
  Description of Artificial Sequence: Synthetic peptide
TTGEAGEAANATSAGATGP

SEQ ID NO: 55 - protein, 19 aa, Artificial Sequence
  Description of Artificial Sequence: Synthetic peptide
TTGEAGEAAGLTPAGLTGP

SEQ ID NO: 56 - protein, 19 aa, Artificial Sequence
  Description of Artificial Sequence: Synthetic peptide
TTGAAGEAANATPAGLTGP

SEQ ID NO: 57 - protein, 19 aa, Artificial Sequence
  Description of Artificial Sequence: Synthetic peptide
TTGRAGEAAGLTPAGLTGP

SEQ ID NO: 58 - protein, 19 aa, Artificial Sequence
  Description of Artificial Sequence: Synthetic peptide
TTGRAGEAANATSAGATGP

SEQ ID NO: 59 - protein, 19 aa, Artificial Sequence
  Description of Artificial Sequence: Synthetic peptide
TTGEAGEAAGATSAGATGP

SEQ ID NO: 60 - protein, 16 aa, Artificial Sequence
  Description of Artificial Sequence: Synthetic peptide
ESGRAANTEPPELGAG

SEQ ID NO: 61 - protein, 16 aa, Artificial Sequence
  Description of Artificial Sequence: Synthetic peptide
ESGRAANTAPEGLTGP

SEQ ID NO: 62 - protein, 16 aa, Artificial Sequence
  Description of Artificial Sequence: Synthetic peptide
EPGRAANHEPSGLTEG

SEQ ID NO: 63 - protein, 19 aa, Artificial Sequence
  Description of Artificial Sequence: Synthetic peptide
ESGRAANHTGAPPGGLTGP

SEQ ID NO: 64 - protein, 19 aa, Artificial Sequence
  Description of Artificial Sequence: Synthetic peptide
TTGRTGEGANATPGGLTGP

SEQ ID NO: 65 - protein, 19 aa, Artificial Sequence
  Description of Artificial Sequence: Synthetic peptide
RTGRSGEAANETPEGLEGP

SEQ ID NO: 66 - protein, 19 aa, Artificial Sequence
  Description of Artificial Sequence: Synthetic peptide
RTGRTGESANETPAGLGGP

SEQ ID NO: 67 - protein, 19 aa, Artificial Sequence
  Description of Artificial Sequence: Synthetic peptide
STGRTGEPANETPAGLSGP

SEQ ID NO: 68 - protein, 19 aa, Artificial Sequence
  Description of Artificial Sequence: Synthetic peptide
TTGRAGEPANATPTGLSGP

SEQ ID NO: 69 - protein, 19 aa, Artificial Sequence
  Description of Artificial Sequence: Synthetic peptide
RTGRPGEGANATPTGLPGP

SEQ ID NO: 70 - protein, 19 aa, Artificial Sequence
  Description of Artificial Sequence: Synthetic peptide
RTGRGGEAANATPSGLGGP

SEQ ID NO: 71 - protein, 19 aa, Artificial Sequence
  Description of Artificial Sequence: Synthetic peptide
STGRSGESANATPGGLGGP

SEQ ID NO: 72 - protein, 19 aa, Artificial Sequence
  Description of Artificial Sequence: Synthetic peptide
RTGRTGEEANATPAGLPGP

SEQ ID NO: 73 - protein, 19 aa, Artificial Sequence
  Description of Artificial Sequence: Synthetic peptide
ATGRPGEPANTTPEGLEGP

SEQ ID NO: 74 - protein, 19 aa, Artificial Sequence
  Description of Artificial Sequence: Synthetic peptide
STGRSGEPANATPGGLTGP

SEQ ID NO: 75 - protein, 19 aa, Artificial Sequence
  Description of Artificial Sequence: Synthetic peptide
PTGRGGEGANTTPTGLPGP

SEQ ID NO: 76 - protein, 19 aa, Artificial Sequence
  Description of Artificial Sequence: Synthetic peptide
PTGRSGEGANATPSGLTGP

SEQ ID NO: 77 - protein, 19 aa, Artificial Sequence
  Description of Artificial Sequence: Synthetic peptide
TTGRASEGANSTPAPLTEP

SEQ ID NO: 78 - protein, 19 aa, Artificial Sequence
  Description of Artificial Sequence: Synthetic peptide
TYGRAAEAANTTPAGLTAP

SEQ ID NO: 79 - protein, 19 aa, Artificial Sequence
  Description of Artificial Sequence: Synthetic peptide
TTGRATEGANATPAELTEP

SEQ ID NO: 80 - protein, 19 aa, Artificial Sequence
  Description of Artificial Sequence: Synthetic peptide
TVGRASEEANTTPASLTGP

SEQ ID NO: 81 - protein, 19 aa, Artificial Sequence
  Description of Artificial Sequence: Synthetic peptide
TTGRAPEAANATPAPLTGP

SEQ ID NO: 82 - protein, 19 aa, Artificial Sequence
  Description of Artificial Sequence: Synthetic peptide
TWGRATEPANATPAPLTSP

SEQ ID NO: 83 - protein, 19 aa, Artificial Sequence
  Description of Artificial Sequence: Synthetic peptide
TVGRASESANATPAELTSP

SEQ ID NO: 84 - protein, 19 aa, Artificial Sequence
  Description of Artificial Sequence: Synthetic peptide
TVGRAPEGANSTPAGLTGP

SEQ ID NO: 85 - protein, 19 aa, Artificial Sequence
  Description of Artificial Sequence: Synthetic peptide
TWGRATEAPNLEPATLTTP

SEQ ID NO: 86 - protein, 19 aa, Artificial Sequence
  Description of Artificial Sequence: Synthetic peptide
TTGRATEAPNLTPAPLTEP

SEQ ID NO: 87 - protein, 19 aa, Artificial Sequence
  Description of Artificial Sequence: Synthetic peptide
TQGRATEAPNLSPAALTSP

SEQ ID NO: 88 - protein, 19 aa, Artificial Sequence
  Description of Artificial Sequence: Synthetic peptide
TQGRAAEAPNLTPATLTAP

SEQ ID NO: 89 - protein, 19 aa, Artificial Sequence
  Description of Artificial Sequence: Synthetic peptide
TSGRAPEATNLAPAPLTGP

SEQ ID NO: 90 - protein, 19 aa, Artificial Sequence
  Description of Artificial Sequence: Synthetic peptide
TQGRAAEAANLTPAGLTEP

SEQ ID NO: 91 - protein, 19 aa, Artificial Sequence
  Description of Artificial Sequence: Synthetic peptide
TTGRAGSAPNLPPTGLTTP

SEQ ID NO: 92 - protein, 19 aa, Artificial Sequence
  Description of Artificial Sequence: Synthetic peptide
TTGRAGGAENLPPEGLTAP

SEQ ID NO: 93 - protein, 19 aa, Artificial Sequence
  Description of Artificial Sequence: Synthetic peptide
TTSRAGTATNLTPEGLTAP

SEQ ID NO: 94 - protein, 19 aa, Artificial Sequence
  Description of Artificial Sequence: Synthetic peptide
TTGRAGTATNLPPSGLTTP

SEQ ID NO: 95 - protein, 19 aa, Artificial Sequence
  Description of Artificial Sequence: Synthetic peptide
TTARAGEAENLSPSGLTAP

SEQ ID NO: 96 - protein, 19 aa, Artificial Sequence
  Description of Artificial Sequence: Synthetic peptide
TTGRAGGAGNLAPGGLTEP

SEQ ID NO: 97 - protein, 19 aa, Artificial Sequence
  Description of Artificial Sequence: Synthetic peptide
TTGRAGTATNLPPEGLTGP

SEQ ID NO: 98 - protein, 19 aa, Artificial Sequence
  Description of Artificial Sequence: Synthetic peptide
TTGRAGGAANLAPTGLTEP

SEQ ID NO: 99 - protein, 19 aa, Artificial Sequence
  Description of Artificial Sequence: Synthetic peptide
TTGRAGTAENLAPSGLTTP

SEQ ID NO: 100 - protein, 19 aa, Artificial Sequence
  Description of Artificial Sequence: Synthetic peptide
TTGRAGSATNLGPGGLTGP

SEQ ID NO: 101 - protein, 19 aa, Artificial Sequence
  Description of Artificial Sequence: Synthetic peptide
TTARAGGAENLTPAGLTEP

SEQ ID NO: 102 - protein, 19 aa, Artificial Sequence
  Description of Artificial Sequence: Synthetic peptide
TTARAGSAENLSPSGLTGP

SEQ ID NO: 103 - protein, 19 aa, Artificial Sequence
  Description of Artificial Sequence: Synthetic peptide
TTARAGGAGNLAPEGLTTP

SEQ ID NO: 104 - protein, 19 aa, Artificial Sequence
  Description of Artificial Sequence: Synthetic peptide
TTSRAGAAENLTPTGLTGP

SEQ ID NO: 105 - protein, 19 aa, Artificial Sequence
  Description of Artificial Sequence: Synthetic peptide
TYGRTTTPGNEPPASLEAE

SEQ ID NO: 106 - protein, 19 aa, Artificial Sequence
  Description of Artificial Sequence: Synthetic peptide
TYSRGESGPNEPPPGLTGP

SEQ ID NO: 107 - protein, 19 aa, Artificial Sequence
  Description of Artificial Sequence: Synthetic peptide
AWGRTGASENETPAPLGGE

SEQ ID NO: 108 - protein, 19 aa, Artificial Sequence
  Description of Artificial Sequence: Synthetic peptide
RWGRAETTPNTPPEGLETE

SEQ ID NO: 109 - protein, 19 aa, Artificial Sequence
  Description of Artificial Sequence: Synthetic peptide
ESGRAANHTGAEPPELGAG

SEQ ID NO: 110 - protein, 19 aa, Artificial Sequence
  Description of Artificial Sequence: Synthetic peptide
TTGRAGEAANLTPAGLTES

SEQ ID NO: 111 - protein, 19 aa, Artificial Sequence
  Description of Artificial Sequence: Synthetic peptide
TTGRAGEAANLTPAALTES

SEQ ID NO: 112 - protein, 19 aa, Artificial Sequence
  Description of Artificial Sequence: Synthetic peptide
TTGRAGEAANLTPAPLTES

SEQ ID NO: 113 - protein, 19 aa, Artificial Sequence
  Description of Artificial Sequence: Synthetic peptide
TTGRAGEAANLTPEPLTES

SEQ ID NO: 114 - protein, 19 aa, Artificial Sequence
  Description of Artificial Sequence: Synthetic peptide
TTGRAGEAANLTPAGLTGA

SEQ ID NO: 115 - protein, 19 aa, Artificial Sequence
  Description of Artificial Sequence: Synthetic peptide
TTGRAGEAANLTPEGLTGA

SEQ ID NO: 116 - protein, 19 aa, Artificial Sequence
  Description of Artificial Sequence: Synthetic peptide
TTGRAGEAANLTPEPLTGA

SEQ ID NO: 117 - protein, 19 aa, Artificial Sequence
  Description of Artificial Sequence: Synthetic peptide
TTGRAGEAANLTPAGLTEA

SEQ ID NO: 118 - protein, 19 aa, Artificial Sequence
  Description of Artificial Sequence: Synthetic peptide
TTGRAGEAANLTPEGLTEA

SEQ ID NO: 119 - protein, 19 aa, Artificial Sequence
  Description of Artificial Sequence: Synthetic peptide
TTGRAGEAANLTPAPLTEA

SEQ ID NO: 120 - protein, 19 aa, Artificial Sequence
  Description of Artificial Sequence: Synthetic peptide
TTGRAGEAANLTPEPLTEA

SEQ ID NO: 121 - protein, 19 aa, Artificial Sequence
  Description of Artificial Sequence: Synthetic peptide
TTGRAGEAANLTPEPLTGP

SEQ ID NO: 122 - protein, 19 aa, Artificial Sequence
  Description of Artificial Sequence: Synthetic peptide
TTGRAGEAANLTPAGLTGG

SEQ ID NO: 123 - protein, 19 aa, Artificial Sequence
  Description of Artificial Sequence: Synthetic peptide
TTGRAGEAANLTPEGLTGG

SEQ ID NO: 124 - protein, 19 aa, Artificial Sequence
  Description of Artificial Sequence: Synthetic peptide
TTGRAGEAANLTPEALTGG

SEQ ID NO: 125 - protein, 19 aa, Artificial Sequence
  Description of Artificial Sequence: Synthetic peptide
TTGRAGEAANLTPEPLTGG

SEQ ID NO: 126 - protein, 19 aa, Artificial Sequence
  Description of Artificial Sequence: Synthetic peptide
TTGRAGEAANLTPAGLTEG

SEQ ID NO: 127 - protein, 19 aa, Artificial Sequence
  Description of Artificial Sequence: Synthetic peptide
TTGRAGEAANLTPEGLTEG

SEQ ID NO: 128 - protein, 19 aa, Artificial Sequence
  Description of Artificial Sequence: Synthetic peptide
TTGRAGEAANLTPAPLTEG

SEQ ID NO: 129 - protein, 19 aa, Artificial Sequence
  Description of Artificial Sequence: Synthetic peptide
TTGRAGEAANLTPEPLTEG

SEQ ID NO: 130 - protein, 29 aa, Artificial Sequence
  Description of Artificial Sequence: Synthetic peptide
GSAPGSAGGYAELRMGGAIATSGSETPGT

SEQ ID NO: 131 - protein, 29 aa, Artificial Sequence
  Description of Artificial Sequence: Synthetic peptide
GSAPGTGGGYAPLRMGGGAATSGSETPGT

SEQ ID NO: 132 - protein, 29 aa, Artificial Sequence
  Description of Artificial Sequence: Synthetic peptide
GSAPGAEGGYAALRMGGEIATSGSETPGT

SEQ ID NO: 133 - protein, 29 aa, Artificial Sequence
  Description of Artificial Sequence: Synthetic peptide
GSAPGGPGGYALLRMGGPAATSGSETPGT

SEQ ID NO: 134 - protein, 29 aa, Artificial Sequence
  Description of Artificial Sequence: Synthetic peptide
GSAPGEAGGYAFLRMGGSIATSGSETPGT

SEQ ID NO: 135 - protein, 29 aa, Artificial Sequence
  Description of Artificial Sequence: Synthetic peptide
GSAPGPGGGYASLRMGGTAATSGSETPGT

SEQ ID NO: 136 - protein, 29 aa, Artificial Sequence
  Description of Artificial Sequence: Synthetic peptide
GSAPGSEGGYATLRMGGAIATSGSETPGT

SEQ ID NO: 137 - protein, 29 aa, Artificial Sequence
  Description of Artificial Sequence: Synthetic peptide
GSAPGTPGGYANLRMGGGAATSGSETPGT

SEQ ID NO: 138 - protein, 29 aa, Artificial Sequence
  Description of Artificial Sequence: Synthetic peptide
GSAPGASGGYAHLRMGGEIATSGSETPGT

SEQ ID NO: 139 - protein, 29 aa, Artificial Sequence
  Description of Artificial Sequence: Synthetic peptide
GSAPGGTGGYGELRMGGPAATSGSETPGT

SEQ ID NO: 140 - protein, 29 aa, Artificial Sequence
  Description of Artificial Sequence: Synthetic peptide
GSAPGEAGGYPELRMGGSIATSGSETPGT

SEQ ID NO: 141 - protein, 29 aa, Artificial Sequence
  Description of Artificial Sequence: Synthetic peptide
GSAPGPGGGYVELRMGGTAATSGSETPGT

SEQ ID NO: 142 - protein, 29 aa, Artificial Sequence
  Description of Artificial Sequence: Synthetic peptide
GSAPGSEGGYLELRMGGAIATSGSETPGT

SEQ ID NO: 143 - protein, 29 aa, Artificial Sequence
  Description of Artificial Sequence: Synthetic peptide
GSAPGTPGGYSELRMGGGAATSGSETPGT

SEQ ID NO: 144 - protein, 29 aa, Artificial Sequence
  Description of Artificial Sequence: Synthetic peptide
GSAPGASGGYTELRMGGEIATSGSETPGT

SEQ ID NO: 145 - protein, 29 aa, Artificial Sequence
  Description of Artificial Sequence: Synthetic peptide
GSAPGGTGGYQELRMGGPAATSGSETPGT

SEQ ID NO: 146 - protein, 29 aa, Artificial Sequence
  Description of Artificial Sequence: Synthetic peptide
GSAPGEAGGYEELRMGGSIATSGSETPGT

SEQ ID NO: 147 - protein, 29 aa, Artificial Sequence
  Description of Artificial Sequence: Synthetic peptide
GSAPGPGIGPAELRMGGTAATSGSETPGT

SEQ ID NO: 148 - protein, 29 aa, Artificial Sequence
  Description of Artificial Sequence: Synthetic peptide
GSAPGSEIGAAELRMGGAIATSGSETPGT

SEQ ID NO: 149 - protein, 29 aa, Artificial Sequence
  Description of Artificial Sequence: Synthetic peptide
GSAPGTPIGSAELRMGGGAATSGSETPGT

SEQ ID NO: 150 - protein, 29 aa, Artificial Sequence
  Description of Artificial Sequence: Synthetic peptide
GSAPGASIGTAELRMGGEIATSGSETPGT

SEQ ID NO: 151 - protein, 29 aa, Artificial Sequence
  Description of Artificial Sequence: Synthetic peptide
GSAPGGTIGNAELRMGGPAATSGSETPGT

SEQ ID NO: 152 - protein, 29 aa, Artificial Sequence
  Description of Artificial Sequence: Synthetic peptide
GSAPGEAIGQAELRMGGSIATSGSETPGT

SEQ ID NO: 153 - protein, 29 aa, Artificial Sequence
  Description of Artificial Sequence: Synthetic peptide
GSAPGPGGPYAELRMGGTAATSGSETPGT

SEQ ID NO: 154 - protein, 29 aa, Artificial Sequence
  Description of Artificial Sequence: Synthetic peptide
GSAPGSEGAYAELRMGGAIATSGSETPGT

SEQ ID NO: 155 - protein, 29 aa, Artificial Sequence
  Description of Artificial Sequence: Synthetic peptide
GSAPGTPGVYAELRMGGGAATSGSETPGT

SEQ ID NO: 156 - protein, 29 aa, Artificial Sequence
  Description of Artificial Sequence: Synthetic peptide
GSAPGASGLYAELRMGGEIATSGSETPGT

SEQ ID NO: 157 - protein, 29 aa, Artificial Sequence
  Description of Artificial Sequence: Synthetic peptide
GSAPGGTGIYAELRMGGPAATSGSETPGT

SEQ ID NO: 158 - protein, 29 aa, Artificial Sequence
  Description of Artificial Sequence: Synthetic peptide
GSAPGEAGFYAELRMGGSIATSGSETPGT

SEQ ID NO: 159 - protein, 29 aa, Artificial Sequence
  Description of Artificial Sequence: Synthetic peptide
GSAPGPGGYYAELRMGGTAATSGSETPGT

SEQ ID NO: 160 - protein, 29 aa, Artificial Sequence
  Description of Artificial Sequence: Synthetic peptide
GSAPGSEGSYAELRMGGAIATSGSETPGT

SEQ ID NO: 161 - protein, 29 aa, Artificial Sequence
  Description of Artificial Sequence: Synthetic peptide
GSAPGTPGNYAELRMGGGAATSGSETPGT

SEQ ID NO: 162 - protein, 29 aa, Artificial Sequence
  Description of Artificial Sequence: Synthetic peptide
GSAPGASGEYAELRMGGEIATSGSETPGT

SEQ ID NO: 163 - protein, 29 aa, Artificial Sequence
  Description of Artificial Sequence: Synthetic peptide
GSAPGGTGHYAELRMGGPAATSGSETPGT

SEQ ID NO: 164 - protein, 29 aa, Artificial Sequence
  Description of Artificial Sequence: Synthetic peptide
GSAPGEAGGYAEARMGGSIATSGSETPGT

SEQ ID NO: 165 - protein, 29 aa, Artificial Sequence
  Description of Artificial Sequence: Synthetic peptide
GSAPGPGGGYAEVRMGGTAATSGSETPGT

SEQ ID NO: 166 - protein, 29 aa, Artificial Sequence
  Description of Artificial Sequence: Synthetic peptide
GSAPGSEGGYAEIRMGGAIATSGSETPGT

SEQ ID NO: 167 - protein, 29 aa, Artificial Sequence
  Description of Artificial Sequence: Synthetic peptide
GSAPGTPGGYAEFRMGGGAATSGSETPGT

SEQ ID NO: 168 - protein, 29 aa, Artificial Sequence
  Description of Artificial Sequence: Synthetic peptide
GSAPGASGGYAEYRMGGEIATSGSETPGT

SEQ ID NO: 169 - protein, 29 aa, Artificial Sequence
  Description of Artificial Sequence: Synthetic peptide
GSAPGGTGGYAESRMGGPAATSGSETPGT

SEQ ID NO: 170 - protein, 29 aa, Artificial Sequence
  Description of Artificial Sequence: Synthetic peptide
GSAPGEAGGYAETRMGGSIATSGSETPGT

SEQ ID NO: 171 - protein, 29 aa, Artificial Sequence
  Description of Artificial Sequence: Synthetic peptide
GSAPGPGGGYAELAMGGTRATSGSETPGT

SEQ ID NO: 172 - protein, 29 aa, Artificial Sequence
  Description of Artificial Sequence: Synthetic peptide
GSAPGSEGGYAELVMGGARATSGSETPGT

SEQ ID NO: 173 - protein, 29 aa, Artificial Sequence
  Description of Artificial Sequence: Synthetic peptide
GSAPGTPGGYAELLMGGGRATSGSETPGT

SEQ ID NO: 174 - protein, 29 aa, Artificial Sequence
  Description of Artificial Sequence: Synthetic peptide
GSAPGASGGYAELIMGGERATSGSETPGT

SEQ ID NO: 175 - protein, 29 aa, Artificial Sequence
  Description of Artificial Sequence: Synthetic peptide
GSAPGGTGGYAELWMGGPRATSGSETPGT

SEQ ID NO: 176 - protein, 29 aa, Artificial Sequence
  Description of Artificial Sequence: Synthetic peptide
GSAPGEAGGYAELSMGGSRATSGSETPGT

SEQ ID NO: 177 - protein, 29 aa, Artificial Sequence
  Description of Artificial Sequence: Synthetic peptide
GSAPGPGGGYAELTMGGTRATSGSETPGT

SEQ ID NO: 178 - protein, 29 aa, Artificial Sequence
  Description of Artificial Sequence: Synthetic peptide
GSAPGSEGGYAELQMGGARATSGSETPGT

SEQ ID NO: 179 - protein, 29 aa, Artificial Sequence
  Description of Artificial Sequence: Synthetic peptide
GSAPGTPGGYAELNMGGGRATSGSETPGT

SEQ ID NO: 180 - protein, 29 aa, Artificial Sequence
  Description of Artificial Sequence: Synthetic peptide
GSAPGASGGYAELEMGGERATSGSETPGT

SEQ ID NO: 181 - protein, 29 aa, Artificial Sequence
  Description of Artificial Sequence: Synthetic peptide
GSAPGGTGGYAELRPGGPIATSGSETPGT

SEQ ID NO: 182 - protein, 29 aa, Artificial Sequence
  Description of Artificial Sequence: Synthetic peptide
GSAPGEAGGYAELRAGGSAATSGSETPGT

SEQ ID NO: 183 - protein, 29 aa, Artificial Sequence
  Description of Artificial Sequence: Synthetic peptide
GSAPGPGGGYAELRLGGTIATSGSETPGT

SEQ ID NO: 184 - protein, 29 aa, Artificial Sequence
  Description of Artificial Sequence: Synthetic peptide
GSAPGSEGGYAELRIGGAAATSGSETPGT

SEQ ID NO: 185 - protein, 29 aa, Artificial Sequence
  Description of Artificial Sequence: Synthetic peptide
GSAPGTPGGYAELRSGGGIATSGSETPGT

SEQ ID NO: 186 - protein, 29 aa, Artificial Sequence
  Description of Artificial Sequence: Synthetic peptide
GSAPGASGGYAELRNGGEAATSGSETPGT

SEQ ID NO: 187 - protein, 29 aa, Artificial Sequence
  Description of Artificial Sequence: Synthetic peptide
GSAPGGTGGYAELRQGGPIATSGSETPGT

SEQ ID NO: 188 - protein, 29 aa, Artificial Sequence
  Description of Artificial Sequence: Synthetic peptide
GSAPGEAGGYAELRDGGSAATSGSETPGT

SEQ ID NO: 189 - protein, 29 aa, Artificial Sequence
  Description of Artificial Sequence: Synthetic peptide
GSAPGPGGGYAELREGGTIATSGSETPGT

SEQ ID NO: 190 - protein, 29 aa, Artificial Sequence
  Description of Artificial Sequence: Synthetic peptide
GSAPGSEGGYAELRHGGAAATSGSETPGT

SEQ ID NO: 191 - protein, 29 aa, Artificial Sequence
  Description of Artificial Sequence: Synthetic peptide
GSAPGTPGGYAELRMPGGIATSGSETPGT

SEQ ID NO: 192 - protein, 29 aa, Artificial Sequence
  Description of Artificial Sequence: Synthetic peptide
GSAPGASGGYAELRMAGEAATSGSETPGT

SEQ ID NO: 193 - protein, 29 aa, Artificial Sequence
  Description of Artificial Sequence: Synthetic peptide
GSAPGGTGGYAELRMVGPIATSGSETPGT

SEQ ID NO: 194 - protein, 29 aa, Artificial Sequence
  Description of Artificial Sequence: Synthetic peptide
GSAPGEAGGYAELRMLGSAATSGSETPGT

SEQ ID NO: 195 - protein, 29 aa, Artificial Sequence
  Description of Artificial Sequence: Synthetic peptide
GSAPGPGGGYAELRMIGTIATSGSETPGT

SEQ ID NO: 196 - protein, 29 aa, Artificial Sequence
  Description of Artificial Sequence: Synthetic peptide
GSAPGSEGGYAELRMYGAIATSGSETPGT

SEQ ID NO: 197 - protein, 29 aa, Artificial Sequence
  Description of Artificial Sequence: Synthetic peptide
GSAPGTPGGYAELRMSGGAATSGSETPGT

SEQ ID NO: 198 - protein, 29 aa, Artificial Sequence
  Description of Artificial Sequence: Synthetic peptide
GSAPGASGGYAELRMNGEIATSGSETPGT

SEQ ID NO: 199 - protein, 29 aa, Artificial Sequence
  Description of Artificial Sequence: Synthetic peptide
GSAPGGTGGYAELRMQGPAATSGSETPGT

SEQ ID NO: 200 - protein, 29 aa, Artificial Sequence
  Description of Artificial Sequence: Synthetic peptide
GSAPGANHTPAGLTGPGARATSGSETPGT

SEQ ID NO: 201 - protein, 29 aa, Artificial Sequence
  Description of Artificial Sequence: Synthetic peptide
GSAPGANTAPEGLTGPSTRATSGSETPGT

SEQ ID NO: 202 - protein, 29 aa, Artificial Sequence
  Description of Artificial Sequence: Synthetic peptide
GSAPGTGAPPGGLTGPGTRATSGSETPGT

SEQ ID NO: 203 - protein, 29 aa, Artificial Sequence
  Description of Artificial Sequence: Synthetic peptide
GSAPGANHEPSGLTEGSPRATSGSETPGT

SEQ ID NO: 204 - protein, 29 aa, Artificial Sequence
  Description of Artificial Sequence: Synthetic peptide
GSAPGANTEPPELGAGTERATSGSETPGT

SEQ ID NO: 205 - protein, 29 aa, Artificial Sequence
  Description of Artificial Sequence: Synthetic peptide
GSAPGASGPPPGLTGPPGRATSGSETPGT

SEQ ID NO: 206 - protein, 29 aa, Artificial Sequence
  Description of Artificial Sequence: Synthetic peptide
GSAPGASGTPAPLGGEPGRATSGSETPGT

SEQ ID NO: 207 - protein, 29 aa, Artificial Sequence
  Description of Artificial Sequence: Synthetic peptide
GSAPGPAGPPEGLETEAGRATSGSETPGT

SEQ ID NO: 208 - protein, 29 aa, Artificial Sequence
  Description of Artificial Sequence: Synthetic peptide
GSAPGPTSGQGGLTGPESRATSGSETPGT

SEQ ID NO: 209 - protein, 29 aa, Artificial Sequence
  Description of Artificial Sequence: Synthetic peptide
GSAPGSAGGAANLVRGGAIATSGSETPGT

SEQ ID NO: 210 - protein, 29 aa, Artificial Sequence
  Description of Artificial Sequence: Synthetic peptide
GSAPGTGGGAAPLVRGGGAATSGSETPGT

SEQ ID NO: 211 - protein, 29 aa, Artificial Sequence
  Description of Artificial Sequence: Synthetic peptide
GSAPGAEGGAAALVRGGEIATSGSETPGT

SEQ ID NO: 212 - protein, 29 aa, Artificial Sequence
  Description of Artificial Sequence: Synthetic peptide
GSAPGGPGGAALLVRGGPAATSGSETPGT

SEQ ID NO: 213 - protein, 29 aa, Artificial Sequence
  Description of Artificial Sequence: Synthetic peptide
GSAPGEAGGAAFLVRGGSIATSGSETPGT

SEQ ID NO: 214 - protein, 29 aa, Artificial Sequence
  Description of Artificial Sequence: Synthetic peptide
GSAPGPGGGAASLVRGGTAATSGSETPGT

SEQ ID NO: 215 - protein, 29 aa, Artificial Sequence
  Description of Artificial Sequence: Synthetic peptide
GSAPGSEGGAATLVRGGAIATSGSETPGT

SEQ ID NO: 216 - protein, 29 aa, Artificial Sequence
  Description of Artificial Sequence: Synthetic peptide
GSAPGTPGGAAGLVRGGGAATSGSETPGT

SEQ ID NO: 217 - protein, 29 aa, Artificial Sequence
  Description of Artificial Sequence: Synthetic peptide
GSAPGASGGAADLVRGGEIATSGSETPGT

SEQ ID NO: 218 - protein, 29 aa, Artificial Sequence
  Description of Artificial Sequence: Synthetic peptide
GSAPGGTGGAGNLVRGGPAATSGSETPGT

SEQ ID NO: 219 - protein, 29 aa, Artificial Sequence
  Description of Artificial Sequence: Synthetic peptide
GSAPGEAGGAPNLVRGGSIATSGSETPGT

SEQ ID NO: 220 - protein, 29 aa, Artificial Sequence
  Description of Artificial Sequence: Synthetic peptide
GSAPGPGGGAVNLVRGGTAATSGSETPGT

SEQ ID NO: 221 - protein, 29 aa, Artificial Sequence
  Description of Artificial Sequence: Synthetic peptide
GSAPGSEGGALNLVRGGAIATSGSETPGT

SEQ ID NO: 222 - protein, 29 aa, Artificial Sequence
  Description of Artificial Sequence: Synthetic peptide
GSAPGTPGGASNLVRGGGAATSGSETPGT

SEQ ID NO: 223 - protein, 29 aa, Artificial Sequence
  Description of Artificial Sequence: Synthetic peptide
GSAPGASGGATNLVRGGEIATSGSETPGT

SEQ ID NO: 224 - protein, 29 aa, Artificial Sequence
  Description of Artificial Sequence: Synthetic peptide
GSAPGGTGGAQNLVRGGPAATSGSETPGT

SEQ ID NO: 225 - protein, 29 aa, Artificial Sequence
  Description of Artificial Sequence: Synthetic peptide
GSAPGEAGGAENLVRGGSIATSGSETPGT

SEQ ID NO: 226 - protein, 30 aa, Artificial Sequence
  Description of Artificial Sequence: Synthetic polypeptide
GSAPEAGRSANHEPLGLVATATSGSETPGT

SEQ ID NO: 227 - protein, 30 aa, Artificial Sequence
  Description of Artificial Sequence: Synthetic polypeptide
GSAPASGRSTNAGPSGLAGPATSGSETPGT

SEQ ID NO: 228 - protein, 30 aa, Artificial Sequence
  Description of Artificial Sequence: Synthetic polypeptide
GSAPASGRSTNAGPQGLAGQATSGSETPGT

SEQ ID NO: 229 - protein, 30 aa, Artificial Sequence
  Description of Artificial Sequence: Synthetic polypeptide
GSAPASGRSTNAGPPGLTGPATSGSETPGT

SEQ ID NO: 230 - protein, 30 aa, Artificial Sequence
  Description of Artificial Sequence: Synthetic polypeptide
GSAPASSRGTNAGPAGLTGPATSGSETPGT

SEQ ID NO: 231 - protein, 30 aa, Artificial Sequence
  Description of Artificial Sequence: Synthetic polypeptide
GSAPASSRTTNTGPSTLTGPATSGSETPGT

SEQ ID NO: 232 - protein, 30 aa, Artificial Sequence
  Description of Artificial Sequence: Synthetic polypeptide
GSAPAAGRSDNGTPLELVAPATSGSETPGT

SEQ ID NO: 233 - protein, 30 aa, Artificial Sequence
  Description of Artificial Sequence: Synthetic polypeptide
GSAPASGRGTNAGPAGLTGPATSGSETPGT

SEQ ID NO: 234 - protein, 30 aa, Artificial Sequence
  Description of Artificial Sequence: Synthetic polypeptide
GSAPLFGRNDNHEPLELGGGATSGSETPGT

SEQ ID NO: 235 - protein, 30 aa, Artificial Sequence
  Description of Artificial Sequence: Synthetic polypeptide
GSAPTAGRSDNLEPLGLVFGATSGSETPGT

SEQ ID NO: 236 - protein, 30 aa, Artificial Sequence
  Description of Artificial Sequence: Synthetic polypeptide
GSAPLDGRSDNFHPPELVAGATSGSETPGT

SEQ ID NO: 237 - protein, 30 aa, Artificial Sequence
  Description of Artificial Sequence: Synthetic polypeptide
GSAPLEGRSDNEEPENLVAGATSGSETPGT

SEQ ID NO: 238 - protein, 30 aa, Artificial Sequence
  Description of Artificial Sequence: Synthetic polypeptide
GSAPLKGRSDNNAPLALVAGATSGSETPGT

SEQ ID NO: 239 - protein, 30 aa, Artificial Sequence
  Description of Artificial Sequence: Synthetic polypeptide
GSAPVYSRGTNAGPHGLTGRATSGSETPGT

SEQ ID NO: 240 - protein, 30 aa, Artificial Sequence
  Description of Artificial Sequence: Synthetic polypeptide
GSAPANSRGTNKGFAGLIGPATSGSETPGT

SEQ ID NO: 241 - protein, 30 aa, Artificial Sequence
  Description of Artificial Sequence: Synthetic polypeptide
GSAPASSRLTNEAPAGLTIPATSGSETPGT

SEQ ID NO: 242 - protein, 30 aa, Artificial Sequence
  Description of Artificial Sequence: Synthetic polypeptide
GSAPDQSRGTNAGPEGLTDPATSGSETPGT

SEQ ID NO: 243 - protein, 30 aa, Artificial Sequence
  Description of Artificial Sequence: Synthetic polypeptide
GSAPESSRGTNIGQGGLTGPATSGSETPGT

SEQ ID NO: 244 - protein, 30 aa, Artificial Sequence
  Description of Artificial Sequence: Synthetic polypeptide
GSAPSSSRGTNQDPAGLTIPATSGSETPGT

SEQ ID NO: 245 - protein, 30 aa, Artificial Sequence
  Description of Artificial Sequence: Synthetic polypeptide
GSAPASSRGQNHSPMGLTGPATSGSETPGT

SEQ ID NO: 246 - protein, 30 aa, Artificial Sequence
  Description of Artificial Sequence: Synthetic polypeptide
GSAPAYSRGPNAGPAGLEGRATSGSETPGT

SEQ ID NO: 247 - protein, 30 aa, Artificial Sequence
  Description of Artificial Sequence: Synthetic polypeptide
GSAPASERGNNAGPANLTGFATSGSETPGT

SEQ ID NO: 248 - protein, 30 aa, Artificial Sequence
  Description of Artificial Sequence: Synthetic polypeptide
GSAPASHRGTNPKPAILTGPATSGSETPGT

SEQ ID NO: 249 - protein, 30 aa, Artificial Sequence
  Description of Artificial Sequence: Synthetic polypeptide
GSAPMSSRRTNANPAQLTGPATSGSETPGT

SEQ ID NO: 250 - protein, 30 aa, Artificial Sequence
  Description of Artificial Sequence: Synthetic polypeptide
GSAPGAGRTDNHEPLELGAAATSGSETPGT

SEQ ID NO: 251 - protein, 30 aa, Artificial Sequence
  Description of Artificial Sequence: Synthetic polypeptide
GSAPLAGRSENTAPLELTAGATSGSETPGT

SEQ ID NO: 252 - protein, 30 aa, Artificial Sequence
  Description of Artificial Sequence: Synthetic polypeptide
GSAPLEGRPDNHEPLALVASATSGSETPGT

SEQ ID NO: 253 - protein, 30 aa, Artificial Sequence
  Description of Artificial Sequence: Synthetic polypeptide
GSAPLSGRSDNEEPLALPAGATSGSETPGT

SEQ ID NO: 254 - protein, 30 aa, Artificial Sequence
  Description of Artificial Sequence: Synthetic polypeptide
GSAPEAGRTDNHEPLELSAPATSGSETPGT

SEQ ID NO: 255 - protein, 30 aa, Artificial Sequence
  Description of Artificial Sequence: Synthetic polypeptide
GSAPEGGRSDNHGPLELVSGATSGSETPGT

SEQ ID NO: 256 - protein, 30 aa, Artificial Sequence
  Description of Artificial Sequence: Synthetic polypeptide
GSAPLSGRSDNEAPLELEAGATSGSETPGT

SEQ ID NO: 257 - protein, 30 aa, Artificial Sequence
  Description of Artificial Sequence: Synthetic polypeptide
GSAPLGGRADNHEPPELGAGATSGSETPGT

SEQ ID NO: 258 - protein, 30 aa, Artificial Sequence
  Description of Artificial Sequence: Synthetic polypeptide
GSAPPPSRGTNAEPAGLTGEATSGSETPGT

SEQ ID NO: 259 - protein, 30 aa, Artificial Sequence
  Description of Artificial Sequence: Synthetic polypeptide
GSAPASTRGENAGPAGLEAPATSGSETPGT

SEQ ID NO: 260 - protein, 30 aa, Artificial Sequence
  Description of Artificial Sequence: Synthetic polypeptide
GSAPESSRGTNGAPEGLTGPATSGSETPGT

SEQ ID NO: 261 - protein, 30 aa, Artificial Sequence
  Description of Artificial Sequence: Synthetic polypeptide
GSAPASSRATNESPAGLTGEATSGSETPGT

SEQ ID NO: 262 - protein, 30 aa, Artificial Sequence
  Description of Artificial Sequence: Synthetic polypeptide
GSAPASSRGENPPPGGLTGPATSGSETPGT

SEQ ID NO: 263 - protein, 30 aa, Artificial Sequence
  Description of Artificial Sequence: Synthetic polypeptide
GSAPAASRGTNTGPAELTGSATSGSETPGT

SEQ ID NO: 264 - protein, 30 aa, Artificial Sequence
  Description of Artificial Sequence: Synthetic polypeptide
GSAPAGSRTTNAGPGGLEGPATSGSETPGT

SEQ ID NO: 265 - protein, 30 aa, Artificial Sequence
  Description of Artificial Sequence: Synthetic polypeptide
GSAPAPSRGENAGPATLTGAATSGSETPGT

SEQ ID NO: 266 - protein, 30 aa, Artificial Sequence
  Description of Artificial Sequence: Synthetic polypeptide
GSAPESGRAANTGPPTLTAPATSGSETPGT

SEQ ID NO: 267 - protein, 30 aa, Artificial Sequence
  Description of Artificial Sequence: Synthetic polypeptide
GSAPNPGRAANEGPPGLPGSATSGSETPGT

SEQ ID NO: 268 - protein, 30 aa, Artificial Sequence
  Description of Artificial Sequence: Synthetic polypeptide
GSAPESSRAANLTPPELTGPATSGSETPGT

SEQ ID NO: 269 - protein, 30 aa, Artificial Sequence
  Description of Artificial Sequence: Synthetic polypeptide
GSAPASGRAANETPPGLTGAATSGSETPGT

SEQ ID NO: 270 - protein, 30 aa, Artificial Sequence
  Description of Artificial Sequence: Synthetic polypeptide
GSAPNSGRGENLGAPGLTGTATSGSETPGT

SEQ ID NO: 271 - protein, 30 aa, Artificial Sequence
  Description of Artificial Sequence: Synthetic polypeptide
GSAPTTGRAANLTPAGLTGPATSGSETPGT

SEQ ID NO: 272 - protein, 30 aa, Artificial Sequence
  Description of Artificial Sequence: Synthetic polypeptide
GSAPEAGRSANHTPAGLTGPATSGSETPGT

SEQ ID NO: 273 - protein, 30 aa, Artificial Sequence
  Description of Artificial Sequence: Synthetic polypeptide
GSAPESGRAANTTPAGLTGPATSGSETPGT

SEQ ID NO: 274 - protein, 33 aa, Artificial Sequence
  Description of Artificial Sequence: Synthetic polypeptide
GSAPTTGRATEAANLTPAGLTGPATSGSETPGT

SEQ ID NO: 275 - protein, 33 aa, Artificial Sequence
  Description of Artificial Sequence: Synthetic polypeptide
GSAPTTGRAEEAANLTPAGLTGPATSGSETPGT

SEQ ID NO: 276 - protein, 33 aa, Artificial Sequence
  Description of Artificial Sequence: Synthetic polypeptide
GSAPTTGRAGEAANLTPAGLTGPATSGSETPGT

SEQ ID NO: 277 - protein, 33 aa, Artificial Sequence
  Description of Artificial Sequence: Synthetic polypeptide
GSAPTTGRATEAANATPAGLTGPATSGSETPGT

SEQ ID NO: 278 - protein, 33 aa, Artificial Sequence
  Description of Artificial Sequence: Synthetic polypeptide
GSAPTTGRAGEAEGATSAGATGPATSGSETPGT

SEQ ID NO: 279 - protein, 33 aa, Artificial Sequence
  Description of Artificial Sequence: Synthetic polypeptide
GSAPTTGEAGEAANATSAGATGPATSGSETPGT

SEQ ID NO: 280 - protein, 33 aa, Artificial Sequence
  Description of Artificial Sequence: Synthetic polypeptide
GSAPTTGEAGEAAGLTPAGLTGPATSGSETPGT

SEQ ID NO: 281 - protein, 33 aa, Artificial Sequence
  Description of Artificial Sequence: Synthetic polypeptide
GSAPTTGAAGEAANATPAGLTGPATSGSETPGT

SEQ ID NO: 282 - protein, 33 aa, Artificial Sequence
  Description of Artificial Sequence: Synthetic polypeptide
GSAPTTGRAGEAAGLTPAGLTGPATSGSETPGT

SEQ ID NO: 283 - protein, 33 aa, Artificial Sequence
  Description of Artificial Sequence: Synthetic polypeptide
GSAPTTGRAGEAANATSAGATGPATSGSETPGT

SEQ ID NO: 284 - protein, 33 aa, Artificial Sequence
  Description of Artificial Sequence: Synthetic polypeptide
GSAPTTGEAGEAAGATSAGATGPATSGSETPGT

SEQ ID NO: 285 - protein, 30 aa, Artificial Sequence
  Description of Artificial Sequence: Synthetic polypeptide
GSAPESGRAANTEPPELGAGATSGSETPGT

SEQ ID NO: 286 - protein, 30 aa, Artificial Sequence
  Description of Artificial Sequence: Synthetic polypeptide
GSAPESGRAANTAPEGLTGPATSGSETPGT

SEQ ID NO: 287 - protein, 30 aa, Artificial Sequence
  Description of Artificial Sequence: Synthetic polypeptide
GSAPEPGRAANHEPSGLTEGATSGSETPGT

SEQ ID NO: 288 - protein, 33 aa, Artificial Sequence
  Description of Artificial Sequence: Synthetic polypeptide
GSAPESGRAANHTGAPPGGLTGPATSGSETPGT

SEQ ID NO: 289 - protein, 33 aa, Artificial Sequence
  Description of Artificial Sequence: Synthetic polypeptide
GSAPTTGRTGEGANATPGGLTGPATSGSETPGT

SEQ ID NO: 290 - protein, 33 aa, Artificial Sequence
  Description of Artificial Sequence: Synthetic polypeptide
GSAPRTGRSGEAANETPEGLEGPATSGSETPGT

SEQ ID NO: 291 - protein, 33 aa, Artificial Sequence
  Description of Artificial Sequence: Synthetic polypeptide
GSAPRTGRTGESANETPAGLGGPATSGSETPGT

SEQ ID NO: 292 - protein, 33 aa, Artificial Sequence
  Description of Artificial Sequence: Synthetic polypeptide
GSAPSTGRTGEPANETPAGLSGPATSGSETPGT

SEQ ID NO: 293 - protein, 33 aa, Artificial Sequence
  Description of Artificial Sequence: Synthetic polypeptide
GSAPTTGRAGEPANATPTGLSGPATSGSETPGT

SEQ ID NO: 294 - protein, 33 aa, Artificial Sequence
  Description of Artificial Sequence: Synthetic polypeptide
GSAPRTGRPGEGANATPTGLPGPATSGSETPGT

SEQ ID NO: 295 - protein, 33 aa, Artificial Sequence
  Description of Artificial Sequence: Synthetic polypeptide
GSAPRTGRGGEAANATPSGLGGPATSGSETPGT

SEQ ID NO: 296 - protein, 33 aa, Artificial Sequence
  Description of Artificial Sequence: Synthetic polypeptide
GSAPSTGRSGESANATPGGLGGPATSGSETPGT

SEQ ID NO: 297 - protein, 33 aa, Artificial Sequence
  Description of Artificial Sequence: Synthetic polypeptide
GSAPRTGRTGEEANATPAGLPGPATSGSETPGT

SEQ ID NO: 298 - protein, 33 aa, Artificial Sequence
  Description of Artificial Sequence: Synthetic polypeptide
GSAPATGRPGEPANTTPEGLEGPATSGSETPGT

SEQ ID NO: 299 - protein, 33 aa, Artificial Sequence
  Description of Artificial Sequence: Synthetic polypeptide
GSAPSTGRSGEPANATPGGLTGPATSGSETPGT

SEQ ID NO: 300 - protein, 33 aa, Artificial Sequence
  Description of Artificial Sequence: Synthetic polypeptide
GSAPPTGRGGEGANTTPTGLPGPATSGSETPGT

SEQ ID NO: 301 - protein, 33 aa, Artificial Sequence
  Description of Artificial Sequence: Synthetic polypeptide
GSAPPTGRSGEGANATPSGLTGPATSGSETPGT

SEQ ID NO: 302 - protein, 33 aa, Artificial Sequence
  Description of Artificial Sequence: Synthetic polypeptide
GSAPTTGRASEGANSTPAPLTEPATSGSETPGT

SEQ ID NO: 303 - protein, 33 aa, Artificial Sequence
  Description of Artificial Sequence: Synthetic polypeptide
GSAPTYGRAAEAANTTPAGLTAPATSGSETPGT

SEQ ID NO: 304 - protein, 33 aa, Artificial Sequence
  Description of Artificial Sequence: Synthetic polypeptide
GSAPTTGRATEGANATPAELTEPATSGSETPGT

SEQ ID NO: 305 - protein, 33 aa, Artificial Sequence
  Description of Artificial Sequence: Synthetic polypeptide
GSAPTVGRASEEANTTPASLTGPATSGSETPGT

SEQ ID NO: 306 - protein, 33 aa, Artificial Sequence
  Description of Artificial Sequence: Synthetic polypeptide
GSAPTTGRAPEAANATPAPLTGPATSGSETPGT

SEQ ID NO: 307 - protein, 33 aa, Artificial Sequence
  Description of Artificial Sequence: Synthetic polypeptide
GSAPTWGRATEPANATPAPLTSPATSGSETPGT

SEQ ID NO: 308 - protein, 33 aa, Artificial Sequence
  Description of Artificial Sequence: Synthetic polypeptide
GSAPTVGRASESANATPAELTSPATSGSETPGT

SEQ ID NO: 309 - protein, 33 aa, Artificial Sequence
  Description of Artificial Sequence: Synthetic polypeptide
GSAPTVGRAPEGANSTPAGLTGPATSGSETPGT

SEQ ID NO: 310 - protein, 33 aa, Artificial Sequence
  Description of Artificial Sequence: Synthetic polypeptide
GSAPTWGRATEAPNLEPATLTTPATSGSETPGT

SEQ ID NO: 311 - protein, 33 aa, Artificial Sequence
  Description of Artificial Sequence: Synthetic polypeptide
GSAPTTGRATEAPNLTPAPLTEPATSGSETPGT

SEQ ID NO: 312 - protein, 33 aa, Artificial Sequence
  Description of Artificial Sequence: Synthetic polypeptide
GSAPTQGRATEAPNLSPAALTSPATSGSETPGT

SEQ ID NO: 313 - protein, 33 aa, Artificial Sequence
  Description of Artificial Sequence: Synthetic polypeptide
GSAPTQGRAAEAPNLTPATLTAPATSGSETPGT

SEQ ID NO: 314 - protein, 33 aa, Artificial Sequence
  Description of Artificial Sequence: Synthetic polypeptide
GSAPTSGRAPEATNLAPAPLTGPATSGSETPGT

SEQ ID NO: 315 - protein, 33 aa, Artificial Sequence
  Description of Artificial Sequence: Synthetic polypeptide
GSAPTQGRAAEAANLTPAGLTEPATSGSETPGT

SEQ ID NO: 316 - protein, 33 aa, Artificial Sequence
  Description of Artificial Sequence: Synthetic polypeptide
GSAPTTGRAGSAPNLPPTGLTTPATSGSETPGT

SEQ ID NO: 317 - protein, 33 aa, Artificial Sequence
  Description of Artificial Sequence: Synthetic polypeptide
GSAPTTGRAGGAENLPPEGLTAPATSGSETPGT

SEQ ID NO: 318 - protein, 33 aa, Artificial Sequence
  Description of Artificial Sequence: Synthetic polypeptide
GSAPTTSRAGTATNLTPEGLTAPATSGSETPGT

SEQ ID NO: 319 - protein, 33 aa, Artificial Sequence
  Description of Artificial Sequence: Synthetic polypeptide
GSAPTTGRAGTATNLPPSGLTTPATSGSETPGT

SEQ ID NO: 320 - protein, 33 aa, Artificial Sequence
  Description of Artificial Sequence: Synthetic polypeptide
GSAPTTARAGEAENLSPSGLTAPATSGSETPGT

SEQ ID NO: 321 - protein, 33 aa, Artificial Sequence
  Description of Artificial Sequence: Synthetic polypeptide
GSAPTTGRAGGAGNLAPGGLTEPATSGSETPGT

SEQ ID NO: 322 - protein, 33 aa, Artificial Sequence
  Description of Artificial Sequence: Synthetic polypeptide
GSAPTTGRAGTATNLPPEGLTGPATSGSETPGT

SEQ ID NO: 323 - protein, 33 aa, Artificial Sequence
  Description of Artificial Sequence: Synthetic polypeptide
GSAPTTGRAGGAANLAPTGLTEPATSGSETPGT

SEQ ID NO: 324 - protein, 33 aa, Artificial Sequence
  Description of Artificial Sequence: Synthetic polypeptide
GSAPTTGRAGTAENLAPSGLTTPATSGSETPGT

SEQ ID NO: 325 - protein, 33 aa, Artificial Sequence
  Description of Artificial Sequence: Synthetic polypeptide
GSAPTTGRAGSATNLGPGGLTGPATSGSETPGT

SEQ ID NO: 326 - protein, 33 aa, Artificial Sequence
  Description of Artificial Sequence: Synthetic polypeptide
GSAPTTARAGGAENLTPAGLTEPATSGSETPGT

SEQ ID NO: 327 - protein, 33 aa, Artificial Sequence
  Description of Artificial Sequence: Synthetic polypeptide
GSAPTTARAGSAENLSPSGLTGPATSGSETPGT

SEQ ID NO: 328 - protein, 33 aa, Artificial Sequence
  Description of Artificial Sequence: Synthetic polypeptide
GSAPTTARAGGAGNLAPEGLTTPATSGSETPGT

SEQ ID NO: 329 - protein, 33 aa, Artificial Sequence
  Description of Artificial Sequence: Synthetic polypeptide
GSAPTTSRAGAAENLTPTGLTGPATSGSETPGT

SEQ ID NO: 330 - protein, 33 aa, Artificial Sequence
  Description of Artificial Sequence: Synthetic polypeptide
GSAPTYGRTTTPGNEPPASLEAEATSGSETPGT

SEQ ID NO: 331 - protein, 33 aa, Artificial Sequence
  Description of Artificial Sequence: Synthetic polypeptide
GSAPTYSRGESGPNEPPPGLTGPATSGSETPGT

SEQ ID NO: 332 - protein, 33 aa, Artificial Sequence
  Description of Artificial Sequence: Synthetic polypeptide
GSAPAWGRTGASENETPAPLGGEATSGSETPGT

SEQ ID NO: 333 - protein, 33 aa, Artificial Sequence
  Description of Artificial Sequence: Synthetic polypeptide
GSAPRWGRAETTPNTPPEGLETEATSGSETPGT

SEQ ID NO: 334 - protein, 33 aa, Artificial Sequence
  Description of Artificial Sequence: Synthetic polypeptide
GSAPESGRAANHTGAEPPELGAGATSGSETPGT

SEQ ID NO: 335 - protein, 33 aa, Artificial Sequence
  Description of Artificial Sequence: Synthetic polypeptide
GSAPTTGRAGEAANLTPAGLTESATSGSETPGT

SEQ ID NO: 336 - protein, 33 aa, Artificial Sequence
  Description of Artificial Sequence: Synthetic polypeptide
GSAPTTGRAGEAANLTPAALTESATSGSETPGT

SEQ ID NO: 337 - protein, 33 aa, Artificial Sequence
  Description of Artificial Sequence: Synthetic polypeptide
GSAPTTGRAGEAANLTPAPLTESATSGSETPGT

SEQ ID NO: 338 - protein, 33 aa, Artificial Sequence
  Description of Artificial Sequence: Synthetic polypeptide
GSAPTTGRAGEAANLTPEPLTESATSGSETPGT

SEQ ID NO: 339 - protein, 33 aa, Artificial Sequence
  Description of Artificial Sequence: Synthetic polypeptide
GSAPTTGRAGEAANLTPAGLTGAATSGSETPGT

SEQ ID NO: 340 - protein, 33 aa, Artificial Sequence
  Description of Artificial Sequence: Synthetic polypeptide
GSAPTTGRAGEAANLTPEGLTGAATSGSETPGT

SEQ ID NO: 341 - protein, 33 aa, Artificial Sequence
  Description of Artificial Sequence: Synthetic polypeptide
GSAPTTGRAGEAANLTPEPLTGAATSGSETPGT

SEQ ID NO: 342 - protein, 33 aa, Artificial Sequence
  Description of Artificial Sequence: Synthetic polypeptide
GSAPTTGRAGEAANLTPAGLTEAATSGSETPGT

SEQ ID NO: 343 - protein, 33 aa, Artificial Sequence
  Description of Artificial Sequence: Synthetic polypeptide
GSAPTTGRAGEAANLTPEGLTEAATSGSETPGT

SEQ ID NO: 344 - protein, 33 aa, Artificial Sequence
  Description of Artificial Sequence: Synthetic polypeptide
GSAPTTGRAGEAANLTPAPLTEAATSGSETPGT

SEQ ID NO: 345 - protein, 33 aa, Artificial Sequence
  Description of Artificial Sequence: Synthetic polypeptide
GSAPTTGRAGEAANLTPEPLTEAATSGSETPGT

SEQ ID NO: 346 - protein, 33 aa, Artificial Sequence
  Description of Artificial Sequence: Synthetic polypeptide
GSAPTTGRAGEAANLTPEPLTGPATSGSETPGT

SEQ ID NO: 347 - protein, 33 aa, Artificial Sequence
  Description of Artificial Sequence: Synthetic polypeptide
GSAPTTGRAGEAANLTPAGLTGGATSGSETPGT

SEQ ID NO: 348 - protein, 33 aa, Artificial Sequence
  Description of Artificial Sequence: Synthetic polypeptide
GSAPTTGRAGEAANLTPEGLTGGATSGSETPGT

SEQ ID NO: 349 - protein, 33 aa, Artificial Sequence
  Description of Artificial Sequence: Synthetic polypeptide
GSAPTTGRAGEAANLTPEALTGGATSGSETPGT

SEQ ID NO: 350 - protein, 33 aa, Artificial Sequence
  Description of Artificial Sequence: Synthetic polypeptide
GSAPTTGRAGEAANLTPEPLTGGATSGSETPGT

SEQ ID NO: 351 - protein, 33 aa, Artificial Sequence
  Description of Artificial Sequence: Synthetic polypeptide
GSAPTTGRAGEAANLTPAGLTEGATSGSETPGT

SEQ ID NO: 352 - protein, 33 aa, Artificial Sequence
  Description of Artificial Sequence: Synthetic polypeptide
GSAPTTGRAGEAANLTPEGLTEGATSGSETPGT

SEQ ID NO: 353 - protein, 33 aa, Artificial Sequence
  Description of Artificial Sequence: Synthetic polypeptide
GSAPTTGRAGEAANLTPAPLTEGATSGSETPGT

SEQ ID NO: 354 - protein, 33 aa, Artificial Sequence
  Description of Artificial Sequence: Synthetic polypeptide
GSAPTTGRAGEAANLTPEPLTEGATSGSETPGT

SEQ ID NO: 355 - protein, 30 aa, Artificial Sequence
  Description of Artificial Sequence: Synthetic polypeptide
GSAPEAGRSAEATSAGATGPATSGSETPGT

SEQ ID NO: 356 - protein, 30 aa, Artificial Sequence
  Description of Artificial Sequence: Synthetic polypeptide
GSAPSASGTYSRGESGPGSPATSGSETPGT

SEQ ID NO: 357 - protein, 30 aa, Artificial Sequence
  Description of Artificial Sequence: Synthetic polypeptide
GSAPSASGEAGRTDTHPGSPATSGSETPGT

SEQ ID NO: 358 - protein, 30 aa, Artificial Sequence
  Description of Artificial Sequence: Synthetic polypeptide
GSAPSASGEPGRAAEHPGSPATSGSETPGT

SEQ ID NO: 359 - protein, 30 aa, Artificial Sequence
  Description of Artificial Sequence: Synthetic polypeptide
GSAPSPAGESSRGTTIAGSPATSGSETPGT

SEQ ID NO: 360 - protein, 30 aa, Artificial Sequence
  Description of Artificial Sequence: Synthetic polypeptide
GSAPEAGESAGATPAGLTGPATSGSETPGT

SEQ ID NO: 361 - protein, 30 aa, Artificial Sequence
  Description of Artificial Sequence: Synthetic polypeptide
GSAPSASGAPLELEAGPGSPATSGSETPGT

SEQ ID NO: 362 - protein, 30 aa, Artificial Sequence
  Description of Artificial Sequence: Synthetic polypeptide
GSAPSASGEPPELGAGPGSPATSGSETPGT

SEQ ID NO: 363 - protein, 30 aa, Artificial Sequence
  Description of Artificial Sequence: Synthetic polypeptide
GSAPSASGEPSGLTEGPGSPATSGSETPGT

SEQ ID NO: 364 - protein, 30 aa, Artificial Sequence
  Description of Artificial Sequence: Synthetic polypeptide
GSAPSASGTPAPLTEPPGSPATSGSETPGT

SEQ ID NO: 365 - protein, 30 aa, Artificial Sequence
  Description of Artificial Sequence: Synthetic polypeptide
GSAPSASGTPAELTEPPGSPATSGSETPGT

SEQ ID NO: 366 - protein, 30 aa, Artificial Sequence
  Description of Artificial Sequence: Synthetic polypeptide
GSAPSASGPPPGLTGPPGSPATSGSETPGT

SEQ ID NO: 367 - protein, 30 aa, Artificial Sequence
  Description of Artificial Sequence: Synthetic polypeptide
GSAPSASGTPAPLGGEPGSPATSGSETPGT

SEQ ID NO: 368 - protein, 30 aa, Artificial Sequence
  Description of Artificial Sequence: Synthetic polypeptide
GSAPSPAGAPEGLTGPAGSPATSGSETPGT

SEQ ID NO: 369 - protein, 30 aa, Artificial Sequence
  Description of Artificial Sequence: Synthetic polypeptide
GSAPSPAGPPEGLETEAGSPATSGSETPGT

SEQ ID NO: 370 - protein, 30 aa, Artificial Sequence
  Description of Artificial Sequence: Synthetic polypeptide
GSAPSPTSGQGGLTGPGSEPATSGSETPGT

SEQ ID NO: 371 - protein, 30 aa, Artificial Sequence
  Description of Artificial Sequence: Synthetic polypeptide
GSAPSESAPPEGLETESTEPATSGSETPGT

SEQ ID NO: 372 - protein, 30 aa, Artificial Sequence
  Description of Artificial Sequence: Synthetic polypeptide
GSAPSEGSEPLELGAASETPATSGSETPGT

SEQ ID NO: 373 - protein, 30 aa, Artificial Sequence
  Description of Artificial Sequence: Synthetic polypeptide
GSAPSEGSGPAGLEAPSETPATSGSETPGT

SEQ ID NO: 374 - protein, 30 aa, Artificial Sequence
  Description of Artificial Sequence: Synthetic polypeptide
GSAPSEPTPPASLEAEPGSPATSGSETPGT

SEQ ID NO: 375 - protein, 29 aa, Artificial Sequence
  Description of Artificial Sequence: Synthetic peptide
GTAEAASASGGSAGGYAELRMGGAIPGSP

SEQ ID NO: 376 - protein, 29 aa, Artificial Sequence
  Description of Artificial Sequence: Synthetic peptide
GTAEAASASGGTGGGYAPLRMGGGAPGSP

SEQ ID NO: 377 - protein, 29 aa, Artificial Sequence
  Description of Artificial Sequence: Synthetic peptide
GTAEAASASGGAEGGYAALRMGGEIPGSP

SEQ ID NO: 378 - protein, 29 aa, Artificial Sequence
  Description of Artificial Sequence: Synthetic peptide
GTAEAASASGGGPGGYALLRMGGPAPGSP

SEQ ID NO: 379 - protein, 29 aa, Artificial Sequence
  Description of Artificial Sequence: Synthetic peptide
GTAEAASASGGEAGGYAFLRMGGSIPGSP

SEQ ID NO: 380 - protein, 29 aa, Artificial Sequence
  Description of Artificial Sequence: Synthetic peptide
GTAEAASASGGPGGGYASLRMGGTAPGSP

SEQ ID NO: 381 - protein, 29 aa, Artificial Sequence
  Description of Artificial Sequence: Synthetic peptide
GTAEAASASGGSEGGYATLRMGGAIPGSP

SEQ ID NO: 382 - protein, 29 aa, Artificial Sequence
  Description of Artificial Sequence: Synthetic peptide
GTAEAASASGGTPGGYANLRMGGGAPGSP

SEQ ID NO: 383 - protein, 29 aa, Artificial Sequence
  Description of Artificial Sequence: Synthetic peptide
GTAEAASASGGASGGYAHLRMGGEIPGSP

SEQ ID NO: 384 - protein, 29 aa, Artificial Sequence
  Description of Artificial Sequence: Synthetic peptide
GTAEAASASGGGTGGYGELRMGGPAPGSP

SEQ ID NO: 385 - protein, 29 aa, Artificial Sequence
  Description of Artificial Sequence: Synthetic peptide
GTAEAASASGGEAGGYPELRMGGSIPGSP

SEQ ID NO: 386 - protein, 29 aa, Artificial Sequence
  Description of Artificial Sequence: Synthetic peptide
GTAEAASASGGPGGGYVELRMGGTAPGSP

SEQ ID NO: 387 - protein, 29 aa, Artificial Sequence
  Description of Artificial Sequence: Synthetic peptide
GTAEAASASGGSEGGYLELRMGGAIPGSP

SEQ ID NO: 388 - protein, 29 aa, Artificial Sequence
  Description of Artificial Sequence: Synthetic peptide
GTAEAASASGGTPGGYSELRMGGGAPGSP

SEQ ID NO: 389 - protein, 29 aa, Artificial Sequence
  Description of Artificial Sequence: Synthetic peptide
GTAEAASASGGASGGYTELRMGGEIPGSP

SEQ ID NO: 390 - protein, 29 aa, Artificial Sequence
  Description of Artificial Sequence: Synthetic peptide
GTAEAASASGGGTGGYQELRMGGPAPGSP

SEQ ID NO: 391 - protein, 29 aa, Artificial Sequence
  Description of Artificial Sequence: Synthetic peptide
GTAEAASASGGEAGGYEELRMGGSIPGSP

SEQ ID NO: 392 - protein, 29 aa, Artificial Sequence
  Description of Artificial Sequence: Synthetic peptide
GTAEAASASGGPGIGPAELRMGGTAPGSP

SEQ ID NO: 393 - protein, 29 aa, Artificial Sequence
  Description of Artificial Sequence: Synthetic peptide
GTAEAASASGGSEIGAAELRMGGAIPGSP

SEQ ID NO: 394 - protein, 29 aa, Artificial Sequence
  Description of Artificial Sequence: Synthetic peptide
GTAEAASASGGTPIGSAELRMGGGAPGSP

SEQ ID NO: 395 - protein, 29 aa, Artificial Sequence
  Description of Artificial Sequence: Synthetic peptide
GTAEAASASGGASIGTAELRMGGEIPGSP

SEQ ID NO: 396 - protein, 29 aa, Artificial Sequence
  Description of Artificial Sequence: Synthetic peptide
GTAEAASASGGGTIGNAELRMGGPAPGSP

SEQ ID NO: 397 - protein, 29 aa, Artificial Sequence
  Description of Artificial Sequence: Synthetic peptide
GTAEAASASGGEAIGQAELRMGGSIPGSP

SEQ ID NO: 398 - protein, 29 aa, Artificial Sequence
  Description of Artificial Sequence: Synthetic peptide
GTAEAASASGGPGGPYAELRMGGTAPGSP

SEQ ID NO: 399 - protein, 29 aa, Artificial Sequence
  Description of Artificial Sequence: Synthetic peptide
GTAEAASASGGSEGAYAELRMGGAIPGSP

SEQ ID NO: 400 - protein, 29 aa, Artificial Sequence
  Description of Artificial Sequence: Synthetic peptide
GTAEAASASGGTPGVYAELRMGGGAPGSP

SEQ ID NO: 401 - protein, 29 aa, Artificial Sequence
  Description of Artificial Sequence: Synthetic peptide
GTAEAASASGGASGLYAELRMGGEIPGSP

SEQ ID NO: 402 - protein, 29 aa, Artificial Sequence
  Description of Artificial Sequence: Synthetic peptide
GTAEAASASGGGTGIYAELRMGGPAPGSP

SEQ ID NO: 403 - protein, 29 aa, Artificial Sequence
  Description of Artificial Sequence: Synthetic peptide
GTAEAASASGGEAGFYAELRMGGSIPGSP

SEQ ID NO: 404 - protein, 29 aa, Artificial Sequence
  Description of Artificial Sequence: Synthetic peptide
GTAEAASASGGPGGYYAELRMGGTAPGSP

SEQ ID NO: 405 - protein, 29 aa, Artificial Sequence
  Description of Artificial Sequence: Synthetic peptide
GTAEAASASGGSEGSYAELRMGGAIPGSP

SEQ ID NO: 406 - protein, 29 aa, Artificial Sequence
  Description of Artificial Sequence: Synthetic peptide
GTAEAASASGGTPGNYAELRMGGGAPGSP

SEQ ID NO: 407 - protein, 29 aa, Artificial Sequence
  Description of Artificial Sequence: Synthetic peptide
GTAEAASASGGASGEYAELRMGGEIPGSP

SEQ ID NO: 408 - protein, 29 aa, Artificial Sequence
  Description of Artificial Sequence: Synthetic peptide
GTAEAASASGGGTGHYAELRMGGPAPGSP

SEQ ID NO: 409 - protein, 29 aa, Artificial Sequence
  Description of Artificial Sequence: Synthetic peptide
GTAEAASASGGEAGGYAEARMGGSIPGSP

SEQ ID NO: 410 - protein, 29 aa, Artificial Sequence
  Description of Artificial Sequence: Synthetic peptide
GTAEAASASGGPGGGYAEVRMGGTAPGSP

SEQ ID NO: 411 - protein, 29 aa, Artificial Sequence
  Description of Artificial Sequence: Synthetic peptide
GTAEAASASGGSEGGYAEIRMGGAIPGSP

SEQ ID NO: 412 - protein, 29 aa, Artificial Sequence
  Description of Artificial Sequence: Synthetic peptide
GTAEAASASGGTPGGYAEFRMGGGAPGSP

SEQ ID NO: 413 - protein, 29 aa, Artificial Sequence
  Description of Artificial Sequence: Synthetic peptide
GTAEAASASGGASGGYAEYRMGGEIPGSP

SEQ ID NO: 414 - protein, 29 aa, Artificial Sequence
  Description of Artificial Sequence: Synthetic peptide
GTAEAASASGGGTGGYAESRMGGPAPGSP

SEQ ID NO: 415 - protein, 29 aa, Artificial Sequence
  Description of Artificial Sequence: Synthetic peptide
GTAEAASASGGEAGGYAETRMGGSIPGSP

SEQ ID NO: 416 - protein, 29 aa, Artificial Sequence
  Description of Artificial Sequence: Synthetic peptide
GTAEAASASGGPGGGYAELAMGGTRPGSP

SEQ ID NO: 417 - protein, 29 aa, Artificial Sequence
  Description of Artificial Sequence: Synthetic peptide
GTAEAASASGGSEGGYAELVMGGARPGSP

SEQ ID NO: 418 - protein, 29 aa, Artificial Sequence
  Description of Artificial Sequence: Synthetic peptide
GTAEAASASGGTPGGYAELLMGGGRPGSP

SEQ ID NO: 419 - protein, 29 aa, Artificial Sequence
  Description of Artificial Sequence: Synthetic peptide
GTAEAASASGGASGGYAELIMGGERPGSP

SEQ ID NO: 420 - protein, 29 aa, Artificial Sequence
  Description of Artificial Sequence: Synthetic peptide
GTAEAASASGGGTGGYAELWMGGPRPGSP

SEQ ID NO: 421 - protein, 29 aa, Artificial Sequence
  Description of Artificial Sequence: Synthetic peptide
GTAEAASASGGEAGGYAELSMGGSRPGSP

SEQ ID NO: 422 - protein, 29 aa, Artificial Sequence
  Description of Artificial Sequence: Synthetic peptide
GTAEAASASGGPGGGYAELTMGGTRPGSP

SEQ ID NO: 423 - protein, 29 aa, Artificial Sequence
  Description of Artificial Sequence: Synthetic peptide
GTAEAASASGGSEGGYAELQMGGARPGSP

SEQ ID NO: 424 - protein, 29 aa, Artificial Sequence
  Description of Artificial Sequence: Synthetic peptide
GTAEAASASGGTPGGYAELNMGGGRPGSP

SEQ ID NO: 425 - protein, 29 aa, Artificial Sequence
  Description of Artificial Sequence: Synthetic peptide
GTAEAASASGGASGGYAELEMGGERPGSP

SEQ ID NO: 426 - protein, 29 aa, Artificial Sequence
  Description of Artificial Sequence: Synthetic peptide
GTAEAASASGGGTGGYAELRPGGPIPGSP

SEQ ID NO: 427 - protein, 29 aa, Artificial Sequence
  Description of Artificial Sequence: Synthetic peptide
GTAEAASASGGEAGGYAELRAGGSAPGSP

SEQ ID NO: 428 - protein, 29 aa, Artificial Sequence
  Description of Artificial Sequence: Synthetic peptide
GTAEAASASGGPGGGYAELRLGGTIPGSP

SEQ ID NO: 429 - protein, 29 aa, Artificial Sequence
  Description of Artificial Sequence: Synthetic peptide
GTAEAASASGGSEGGYAELRIGGAAPGSP

SEQ ID NO: 430 - protein, 29 aa, Artificial Sequence
  Description of Artificial Sequence: Synthetic peptide
GTAEAASASGGTPGGYAELRSGGGIPGSP

SEQ ID NO: 431 - protein, 29 aa, Artificial Sequence
  Description of Artificial Sequence: Synthetic peptide
GTAEAASASGGASGGYAELRNGGEAPGSP

SEQ ID NO: 432 - protein, 29 aa, Artificial Sequence
  Description of Artificial Sequence: Synthetic peptide
GTAEAASASGGGTGGYAELRQGGPIPGSP

SEQ ID NO: 433 - protein, 29 aa, Artificial Sequence
  Description of Artificial Sequence: Synthetic peptide
GTAEAASASGGEAGGYAELRDGGSAPGSP

SEQ ID NO: 434 - protein, 29 aa, Artificial Sequence
  Description of Artificial Sequence: Synthetic peptide
GTAEAASASGGPGGGYAELREGGTIPGSP

SEQ ID NO: 435 - protein, 29 aa, Artificial Sequence
  Description of Artificial Sequence: Synthetic peptide
GTAEAASASGGSEGGYAELRHGGAAPGSP

SEQ ID NO: 436 - protein, 29 aa, Artificial Sequence
  Description of Artificial Sequence: Synthetic peptide
GTAEAASASGGTPGGYAELRMPGGIPGSP

SEQ ID NO: 437 - protein, 29 aa, Artificial Sequence
  Description of Artificial Sequence: Synthetic peptide
GTAEAASASGGASGGYAELRMAGEAPGSP

SEQ ID NO: 438 - protein, 29 aa, Artificial Sequence
  Description of Artificial Sequence: Synthetic peptide
GTAEAASASGGGTGGYAELRMVGPIPGSP

SEQ ID NO: 439 - protein, 29 aa, Artificial Sequence
  Description of Artificial Sequence: Synthetic peptide
GTAEAASASGGEAGGYAELRMLGSAPGSP

SEQ ID NO: 440 - protein, 29 aa, Artificial Sequence
  Description of Artificial Sequence: Synthetic peptide
GTAEAASASGGPGGGYAELRMIGTIPGSP

SEQ ID NO: 441 - protein, 29 aa, Artificial Sequence
  Description of Artificial Sequence: Synthetic peptide
GTAEAASASGGSEGGYAELRMYGAIPGSP

SEQ ID NO: 442 - protein, 29 aa, Artificial Sequence
  Description of Artificial Sequence: Synthetic peptide
GTAEAASASGGTPGGYAELRMSGGAPGSP

SEQ ID NO: 443 - protein, 29 aa, Artificial Sequence
  Description of Artificial Sequence: Synthetic peptide
GTAEAASASGGASGGYAELRMNGEIPGSP

SEQ ID NO: 444 - protein, 29 aa, Artificial Sequence
  Description of Artificial Sequence: Synthetic peptide
GTAEAASASGGGTGGYAELRMQGPAPGSP

SEQ ID NO: 445 - protein, 29 aa, Artificial Sequence
  Description of Artificial Sequence: Synthetic peptide
GTAEAASASGGANHTPAGLTGPGARPGSP

SEQ ID NO: 446 - protein, 29 aa, Artificial Sequence
  Description of Artificial Sequence: Synthetic peptide
GTAEAASASGGANTAPEGLTGPSTRPGSP

SEQ ID NO: 447 - protein, 29 aa, Artificial Sequence
  Description of Artificial Sequence: Synthetic peptide
GTAEAASASGGTGAPPGGLTGPGTRPGSP

SEQ ID NO: 448 - protein, 29 aa, Artificial Sequence
  Description of Artificial Sequence: Synthetic peptide
GTAEAASASGGANHEPSGLTEGSPRPGSP

SEQ ID NO: 449 - protein, 29 aa, Artificial Sequence
  Description of Artificial Sequence: Synthetic peptide
GTAEAASASGGANTEPPELGAGTERPGSP

SEQ ID NO: 450 - protein, 29 aa, Artificial Sequence
  Description of Artificial Sequence: Synthetic peptide
GTAEAASASGGASGPPPGLTGPPGRPGSP

SEQ ID NO: 451 - protein, 29 aa, Artificial Sequence
  Description of Artificial Sequence: Synthetic peptide
GTAEAASASGGASGTPAPLGGEPGRPGSP

SEQ ID NO: 452 - protein, 29 aa, Artificial Sequence
  Description of Artificial Sequence: Synthetic peptide
GTAEAASASGGPAGPPEGLETEAGRPGSP

SEQ ID NO: 453 - protein, 29 aa, Artificial Sequence
  Description of Artificial Sequence: Synthetic peptide
GTAEAASASGGPTSGQGGLTGPESRPGSP

SEQ ID NO: 454 - protein, 29 aa, Artificial Sequence
  Description of Artificial Sequence: Synthetic peptide
GTAEAASASGGSAGGAANLVRGGAIPGSP

SEQ ID NO: 455 - protein, 29 aa, Artificial Sequence
  Description of Artificial Sequence: Synthetic peptide
GTAEAASASGGTGGGAAPLVRGGGAPGSP

SEQ ID NO: 456 - protein, 29 aa, Artificial Sequence
  Description of Artificial Sequence: Synthetic peptide
GTAEAASASGGAEGGAAALVRGGEIPGSP

SEQ ID NO: 457 - protein, 29 aa, Artificial Sequence
  Description of Artificial Sequence: Synthetic peptide
GTAEAASASGGGPGGAALLVRGGPAPGSP

SEQ ID NO: 458 - protein, 29 aa, Artificial Sequence
  Description of Artificial Sequence: Synthetic peptide
GTAEAASASGGEAGGAAFLVRGGSIPGSP

SEQ ID NO: 459 - protein, 29 aa, Artificial Sequence
  Description of Artificial Sequence: Synthetic peptide
GTAEAASASGGPGGGAASLVRGGTAPGSP

SEQ ID NO: 460 - protein, 29 aa, Artificial Sequence
  Description of Artificial Sequence: Synthetic peptide
GTAEAASASGGSEGGAATLVRGGAIPGSP

SEQ ID NO: 461 - protein, 29 aa, Artificial Sequence
  Description of Artificial Sequence: Synthetic peptide
GTAEAASASGGTPGGAAGLVRGGGAPGSP

SEQ ID NO: 462 - protein, 29 aa, Artificial Sequence
  Description of Artificial Sequence: Synthetic peptide
GTAEAASASGGASGGAADLVRGGEIPGSP

SEQ ID NO: 463 - protein, 29 aa, Artificial Sequence
  Description of Artificial Sequence: Synthetic peptide
GTAEAASASGGGTGGAGNLVRGGPAPGSP

SEQ ID NO: 464 - protein, 29 aa, Artificial Sequence
  Description of Artificial Sequence: Synthetic peptide
GTAEAASASGGEAGGAPNLVRGGSIPGSP

SEQ ID NO: 465 - protein, 29 aa, Artificial Sequence
  Description of Artificial Sequence: Synthetic peptide
GTAEAASASGGPGGGAVNLVRGGTAPGSP

SEQ ID NO: 466 - protein, 29 aa, Artificial Sequence
  Description of Artificial Sequence: Synthetic peptide
GTAEAASASGGSEGGALNLVRGGAIPGSP

SEQ ID NO: 467 - protein, 29 aa, Artificial Sequence
  Description of Artificial Sequence: Synthetic peptide
GTAEAASASGGTPGGASNLVRGGGAPGSP

SEQ ID NO: 468 - protein, 29 aa, Artificial Sequence
  Description of Artificial Sequence: Synthetic peptide
GTAEAASASGGASGGATNLVRGGEIPGSP

SEQ ID NO: 469 - protein, 29 aa, Artificial Sequence
  Description of Artificial Sequence: Synthetic peptide
GTAEAASASGGGTGGAQNLVRGGPAPGSP

SEQ ID NO: 470 - protein, 29 aa, Artificial Sequence
  Description of Artificial Sequence: Synthetic peptide
GTAEAASASGGEAGGAENLVRGGSIPGSP

SEQ ID NO: 471 - protein, 30 aa, Artificial Sequence
  Description of Artificial Sequence: Synthetic polypeptide
GTAEAASASGEAGRSANHEPLGLVATPGSP

SEQ ID NO: 472 - protein, 30 aa, Artificial Sequence
  Description of Artificial Sequence: Synthetic polypeptide
GTAEAASASGASGRSTNAGPSGLAGPPGSP

SEQ ID NO: 473 - protein, 30 aa, Artificial Sequence
  Description of Artificial Sequence: Synthetic polypeptide
GTAEAASASGASGRSTNAGPQGLAGQPGSP

SEQ ID NO: 474 - protein, 30 aa, Artificial Sequence
  Description of Artificial Sequence: Synthetic polypeptide
GTAEAASASGASGRSTNAGPPGLTGPPGSP

SEQ ID NO: 475 - protein, 30 aa, Artificial Sequence
  Description of Artificial Sequence: Synthetic polypeptide
GTAEAASASGASSRGTNAGPAGLTGPPGSP

SEQ ID NO: 476 - protein, 30 aa, Artificial Sequence
  Description of Artificial Sequence: Synthetic polypeptide
GTAEAASASGASSRTTNTGPSTLTGPPGSP

SEQ ID NO: 477 - protein, 30 aa, Artificial Sequence
  Description of Artificial Sequence: Synthetic polypeptide
GTAEAASASGAAGRSDNGTPLELVAPPGSP

SEQ ID NO: 478 - protein, 30 aa, Artificial Sequence
  Description of Artificial Sequence: Synthetic polypeptide
GTAEAASASGASGRGTNAGPAGLTGPPGSP

SEQ ID NO: 479 - protein, 30 aa, Artificial Sequence
  Description of Artificial Sequence: Synthetic polypeptide
GTAEAASASGLFGRNDNHEPLELGGGPGSP

SEQ ID NO: 480 - protein, 30 aa, Artificial Sequence
  Description of Artificial Sequence: Synthetic polypeptide
GTAEAASASGTAGRSDNLEPLGLVFGPGSP

SEQ ID NO: 481 - protein, 30 aa, Artificial Sequence
  Description of Artificial Sequence: Synthetic polypeptide
GTAEAASASGLDGRSDNFHPPELVAGPGSP

SEQ ID NO: 482 - protein, 30 aa, Artificial Sequence
  Description of Artificial Sequence: Synthetic polypeptide
GTAEAASASGLEGRSDNEEPENLVAGPGSP

SEQ ID NO: 483 - protein, 30 aa, Artificial Sequence
  Description of Artificial Sequence: Synthetic polypeptide
GTAEAASASGLKGRSDNNAPLALVAGPGSP

SEQ ID NO: 484 - protein, 30 aa, Artificial Sequence
  Description of Artificial Sequence: Synthetic polypeptide
GTAEAASASGVYSRGTNAGPHGLTGRPGSP

SEQ ID NO: 485 - protein, 30 aa, Artificial Sequence
  Description of Artificial Sequence: Synthetic polypeptide
GTAEAASASGANSRGTNKGFAGLIGPPGSP

SEQ ID NO: 486 - protein, 30 aa, Artificial Sequence
  Description of Artificial Sequence: Synthetic polypeptide
GTAEAASASGASSRLTNEAPAGLTIPPGSP

SEQ ID NO: 487 - protein, 30 aa, Artificial Sequence
  Description of Artificial Sequence: Synthetic polypeptide
GTAEAASASGDQSRGTNAGPEGLTDPPGSP

SEQ ID NO: 488 - protein, 30 aa, Artificial Sequence
  Description of Artificial Sequence: Synthetic polypeptide
GTAEAASASGESSRGTNIGQGGLTGPPGSP

SEQ ID NO: 489 - protein, 30 aa, Artificial Sequence
  Description of Artificial Sequence: Synthetic polypeptide
GTAEAASASGSSSRGTNQDPAGLTIPPGSP

SEQ ID NO: 490 - protein, 30 aa, Artificial Sequence
  Description of Artificial Sequence: Synthetic polypeptide
GTAEAASASGASSRGQNHSPMGLTGPPGSP

SEQ ID NO: 491 - protein, 30 aa, Artificial Sequence
  Description of Artificial Sequence: Synthetic polypeptide
GTAEAASASGAYSRGPNAGPAGLEGRPGSP

SEQ ID NO: 492 - protein, 30 aa, Artificial Sequence
  Description of Artificial Sequence: Synthetic polypeptide
GTAEAASASGASERGNNAGPANLTGFPGSP

SEQ ID NO: 493 - protein, 30 aa, Artificial Sequence
  Description of Artificial Sequence: Synthetic polypeptide
GTAEAASASGASHRGTNPKPAILTGPPGSP

SEQ ID NO: 494 - protein, 30 aa, Artificial Sequence
  Description of Artificial Sequence: Synthetic polypeptide
GTAEAASASGMSSRRTNANPAQLTGPPGSP

SEQ ID NO: 495 - protein, 30 aa, Artificial Sequence
  Description of Artificial Sequence: Synthetic polypeptide
GTAEAASASGGAGRTDNHEPLELGAAPGSP

SEQ ID NO: 496 - protein, 30 aa, Artificial Sequence
  Description of Artificial Sequence: Synthetic polypeptide
GTAEAASASGLAGRSENTAPLELTAGPGSP

SEQ ID NO: 497 - protein, 30 aa, Artificial Sequence
  Description of Artificial Sequence: Synthetic polypeptide
GTAEAASASGLEGRPDNHEPLALVASPGSP

SEQ ID NO: 498 - protein, 30 aa, Artificial Sequence
  Description of Artificial Sequence: Synthetic polypeptide
GTAEAASASGLSGRSDNEEPLALPAGPGSP

SEQ ID NO: 499 - protein, 30 aa, Artificial Sequence
  Description of Artificial Sequence: Synthetic polypeptide
GTAEAASASGEAGRTDNHEPLELSAPPGSP

SEQ ID NO: 500 - protein, 30 aa, Artificial Sequence
  Description of Artificial Sequence: Synthetic polypeptide
GTAEAASASGEGGRSDNHGPLELVSGPGSP

SEQ ID NO: 501 - protein, 30 aa, Artificial Sequence
  Description of Artificial Sequence: Synthetic polypeptide
GTAEAASASGLSGRSDNEAPLELEAGPGSP

SEQ ID NO: 502 - protein, 30 aa, Artificial Sequence
  Description of Artificial Sequence: Synthetic polypeptide
GTAEAASASGLGGRADNHEPPELGAGPGSP

SEQ ID NO: 503 - protein, 30 aa, Artificial Sequence
  Description of Artificial Sequence: Synthetic polypeptide
GTAEAASASGPPSRGTNAEPAGLTGEPGSP

SEQ ID NO: 504 - protein, 30 aa, Artificial Sequence
  Description of Artificial Sequence: Synthetic polypeptide
GTAEAASASGASTRGENAGPAGLEAPPGSP

SEQ ID NO: 505 - protein, 30 aa, Artificial Sequence
  Description of Artificial Sequence: Synthetic polypeptide
GTAEAASASGESSRGTNGAPEGLTGPPGSP

SEQ ID NO: 506 - protein, 30 aa, Artificial Sequence
  Description of Artificial Sequence: Synthetic polypeptide
GTAEAASASGASSRATNESPAGLTGEPGSP

SEQ ID NO: 507 - protein, 30 aa, Artificial Sequence
  Description of Artificial Sequence: Synthetic polypeptide
GTAEAASASGASSRGENPPPGGLTGPPGSP

SEQ ID NO: 508 - protein, 30 aa, Artificial Sequence
  Description of Artificial Sequence: Synthetic polypeptide
GTAEAASASGAASRGTNTGPAELTGSPGSP

SEQ ID NO: 509 - protein, 30 aa, Artificial Sequence
  Description of Artificial Sequence: Synthetic polypeptide
GTAEAASASGAGSRTTNAGPGGLEGPPGSP

SEQ ID NO: 510 - protein, 30 aa, Artificial Sequence
  Description of Artificial Sequence: Synthetic polypeptide
GTAEAASASGAPSRGENAGPATLTGAPGSP

SEQ ID NO: 511 - protein, 30 aa, Artificial Sequence
  Description of Artificial Sequence: Synthetic polypeptide
GTAEAASASGESGRAANTGPPTLTAPPGSP

SEQ ID NO: 512 - protein, 30 aa, Artificial Sequence
  Description of Artificial Sequence: Synthetic polypeptide
GTAEAASASGNPGRAANEGPPGLPGSPGSP

SEQ ID NO: 513 - protein, 30 aa, Artificial Sequence
  Description of Artificial Sequence: Synthetic polypeptide
GTAEAASASGESSRAANLTPPELTGPPGSP

SEQ ID NO: 514 - protein, 30 aa, Artificial Sequence
  Description of Artificial Sequence: Synthetic polypeptide
GTAEAASASGASGRAANETPPGLTGAPGSP

SEQ ID NO: 515 - protein, 30 aa, Artificial Sequence
  Description of Artificial Sequence: Synthetic polypeptide
GTAEAASASGNSGRGENLGAPGLTGTPGSP

SEQ ID NO: 516 - protein, 30 aa, Artificial Sequence
  Description of Artificial Sequence: Synthetic polypeptide
GTAEAASASGTTGRAANLTPAGLTGPPGSP

SEQ ID NO: 517 - protein, 30 aa, Artificial Sequence
  Description of Artificial Sequence: Synthetic polypeptide
GTAEAASASGEAGRSANHTPAGLTGPPGSP

SEQ ID NO: 518 - protein, 30 aa, Artificial Sequence
  Description of Artificial Sequence: Synthetic polypeptide
GTAEAASASGESGRAANTTPAGLTGPPGSP

SEQ ID NO: 519 - protein, 33 aa, Artificial Sequence
  Description of Artificial Sequence: Synthetic polypeptide
GTAEAASASGTTGRATEAANLTPAGLTGPPGSP

SEQ ID NO: 520 - protein, 33 aa, Artificial Sequence
  Description of Artificial Sequence: Synthetic polypeptide
GTAEAASASGTTGRAEEAANLTPAGLTGPPGSP

SEQ ID NO: 521 - protein, 33 aa, Artificial Sequence
  Description of Artificial Sequence: Synthetic polypeptide
GTAEAASASGTTGRAGEAANLTPAGLTGPPGSP

SEQ ID NO: 522 - protein, 33 aa, Artificial Sequence
  Description of Artificial Sequence: Synthetic polypeptide
GTAEAASASGTTGRATEAANATPAGLTGPPGSP

SEQ ID NO: 523 - protein, 33 aa, Artificial Sequence
  Description of Artificial Sequence: Synthetic polypeptide
GTAEAASASGTTGRAGEAEGATSAGATGPPGSP

SEQ ID NO: 524 - protein, 33 aa, Artificial Sequence
  Description of Artificial Sequence: Synthetic polypeptide
GTAEAASASGTTGEAGEAANATSAGATGPPGSP

SEQ ID NO: 525 - protein, 33 aa, Artificial Sequence
  Description of Artificial Sequence: Synthetic polypeptide
GTAEAASASGTTGEAGEAAGLTPAGLTGPPGSP

SEQ ID NO: 526 - protein, 33 aa, Artificial Sequence
  Description of Artificial Sequence: Synthetic polypeptide
GTAEAASASGTTGAAGEAANATPAGLTGPPGSP

SEQ ID NO: 527 - protein, 33 aa, Artificial Sequence
  Description of Artificial Sequence: Synthetic polypeptide
GTAEAASASGTTGRAGEAAGLTPAGLTGPPGSP

SEQ ID NO: 528 - protein, 33 aa, Artificial Sequence
  Description of Artificial Sequence: Synthetic polypeptide
GTAEAASASGTTGRAGEAANATSAGATGPPGSP

SEQ ID NO: 529 - protein, 33 aa, Artificial Sequence
  Description of Artificial Sequence: Synthetic polypeptide
GTAEAASASGTTGEAGEAAGATSAGATGPPGSP

SEQ ID NO: 530 - protein, 30 aa, Artificial Sequence
  Description of Artificial Sequence: Synthetic polypeptide
GTAEAASASGESGRAANTEPPELGAGPGSP

SEQ ID NO: 531 - protein, 30 aa, Artificial Sequence
  Description of Artificial Sequence: Synthetic polypeptide
GTAEAASASGESGRAANTAPEGLTGPPGSP

SEQ ID NO: 532 - protein, 30 aa, Artificial Sequence
  Description of Artificial Sequence: Synthetic polypeptide
GTAEAASASGEPGRAANHEPSGLTEGPGSP

SEQ ID NO: 533 - protein, 33 aa, Artificial Sequence
  Description of Artificial Sequence: Synthetic polypeptide
GTAEAASASGESGRAANHTGAPPGGLTGPPGSP

SEQ ID NO: 534 - protein, 33 aa, Artificial Sequence
  Description of Artificial Sequence: Synthetic polypeptide
GTAEAASASGTTGRTGEGANATPGGLTGPPGSP

SEQ ID NO: 535 - protein, 33 aa, Artificial Sequence
  Description of Artificial Sequence: Synthetic polypeptide
GTAEAASASGRTGRSGEAANETPEGLEGPPGSP

SEQ ID NO: 536 - protein, 33 aa, Artificial Sequence
  Description of Artificial Sequence: Synthetic polypeptide
GTAEAASASGRTGRTGESANETPAGLGGPPGSP

SEQ ID NO: 537 - protein, 33 aa, Artificial Sequence
  Description of Artificial Sequence: Synthetic polypeptide
GTAEAASASGSTGRTGEPANETPAGLSGPPGSP

SEQ ID NO: 538 - protein, 33 aa, Artificial Sequence
  Description of Artificial Sequence: Synthetic polypeptide
GTAEAASASGTTGRAGEPANATPTGLSGPPGSP

SEQ ID NO: 539 - protein, 33 aa, Artificial Sequence
  Description of Artificial Sequence: Synthetic polypeptide
GTAEAASASGRTGRPGEGANATPTGLPGPPGSP

SEQ ID NO: 540 - protein, 33 aa, Artificial Sequence
  Description of Artificial Sequence: Synthetic polypeptide
GTAEAASASGRTGRGGEAANATPSGLGGPPGSP

SEQ ID NO: 541 - protein, 33 aa, Artificial Sequence
  Description of Artificial Sequence: Synthetic polypeptide
GTAEAASASGSTGRSGESANATPGGLGGPPGSP

SEQ ID NO: 542 - protein, 33 aa, Artificial Sequence
  Description of Artificial Sequence: Synthetic polypeptide
GTAEAASASGRTGRTGEEANATPAGLPGPPGSP

SEQ ID NO: 543 - protein, 33 aa, Artificial Sequence
  Description of Artificial Sequence: Synthetic polypeptide
GTAEAASASGATGRPGEPANTTPEGLEGPPGSP

SEQ ID NO: 544 - protein, 33 aa, Artificial Sequence
  Description of Artificial Sequence: Synthetic polypeptide
GTAEAASASGSTGRSGEPANATPGGLTGPPGSP

SEQ ID NO: 545 - protein, 33 aa, Artificial Sequence
  Description of Artificial Sequence: Synthetic polypeptide
GTAEAASASGPTGRGGEGANTTPTGLPGPPGSP

SEQ ID NO: 546 - protein, 33 aa, Artificial Sequence
  Description of Artificial Sequence: Synthetic polypeptide
GTAEAASASGPTGRSGEGANATPSGLTGPPGSP

SEQ ID NO: 547 - protein, 33 aa, Artificial Sequence
  Description of Artificial Sequence: Synthetic polypeptide
GTAEAASASGTTGRASEGANSTPAPLTEPPGSP

SEQ ID NO: 548 - protein, 33 aa, Artificial Sequence
  Description of Artificial Sequence: Synthetic polypeptide
GTAEAASASGTYGRAAEAANTTPAGLTAPPGSP

SEQ ID NO: 549 - protein, 33 aa, Artificial Sequence
  Description of Artificial Sequence: Synthetic polypeptide
GTAEAASASGTTGRATEGANATPAELTEPPGSP

SEQ ID NO: 550 - protein, 33 aa, Artificial Sequence
  Description of Artificial Sequence: Synthetic polypeptide
GTAEAASASGTVGRASEEANTTPASLTGPPGSP

SEQ ID NO: 551 - protein, 33 aa, Artificial Sequence
  Description of Artificial Sequence: Synthetic polypeptide
GTAEAASASGTTGRAPEAANATPAPLTGPPGSP

SEQ ID NO: 552 - protein, 33 aa, Artificial Sequence
  Description of Artificial Sequence: Synthetic polypeptide
GTAEAASASGTWGRATEPANATPAPLTSPPGSP

SEQ ID NO: 553 - protein, 33 aa, Artificial Sequence
  Description of Artificial Sequence: Synthetic polypeptide
GTAEAASASGTVGRASESANATPAELTSPPGSP

SEQ ID NO: 554 - protein, 33 aa, Artificial Sequence
  Description of Artificial Sequence: Synthetic polypeptide
GTAEAASASGTVGRAPEGANSTPAGLTGPPGSP

SEQ ID NO: 555 - protein, 33 aa, Artificial Sequence
  Description of Artificial Sequence: Synthetic polypeptide
GTAEAASASGTWGRATEAPNLEPATLTTPPGSP

SEQ ID NO: 556 - protein, 33 aa, Artificial Sequence
  Description of Artificial Sequence: Synthetic polypeptide
GTAEAASASGTTGRATEAPNLTPAPLTEPPGSP

SEQ ID NO: 557 - protein, 33 aa, Artificial Sequence
  Description of Artificial Sequence: Synthetic polypeptide
GTAEAASASGTQGRATEAPNLSPAALTSPPGSP

SEQ ID NO: 558 - protein, 33 aa, Artificial Sequence
  Description of Artificial Sequence: Synthetic polypeptide
GTAEAASASGTQGRAAEAPNLTPATLTAPPGSP

SEQ ID NO: 559 - protein, 33 aa, Artificial Sequence
  Description of Artificial Sequence: Synthetic polypeptide
GTAEAASASGTSGRAPEATNLAPAPLTGPPGSP

SEQ ID NO: 560 - protein, 33 aa, Artificial Sequence
  Description of Artificial Sequence: Synthetic polypeptide
GTAEAASASGTQGRAAEAANLTPAGLTEPPGSP

SEQ ID NO: 561 - protein, 33 aa, Artificial Sequence
  Description of Artificial Sequence: Synthetic polypeptide
GTAEAASASGTTGRAGSAPNLPPTGLTTPPGSP

SEQ ID NO: 562 - protein, 33 aa, Artificial Sequence
  Description of Artificial Sequence: Synthetic polypeptide
GTAEAASASGTTGRAGGAENLPPEGLTAPPGSP

SEQ ID NO: 563 - protein, 33 aa, Artificial Sequence
  Description of Artificial Sequence: Synthetic polypeptide
GTAEAASASGTTSRAGTATNLTPEGLTAPPGSP

SEQ ID NO: 564 - protein, 33 aa, Artificial Sequence
  Description of Artificial Sequence: Synthetic polypeptide
GTAEAASASGTTGRAGTATNLPPSGLTTPPGSP

SEQ ID NO: 565 - protein, 33 aa, Artificial Sequence
  Description of Artificial Sequence: Synthetic polypeptide
GTAEAASASGTTARAGEAENLSPSGLTAPPGSP

SEQ ID NO: 566 - protein, 33 aa, Artificial Sequence
  Description of Artificial Sequence: Synthetic polypeptide
GTAEAASASGTTGRAGGAGNLAPGGLTEPPGSP

SEQ ID NO: 567 - protein, 33 aa, Artificial Sequence
  Description of Artificial Sequence: Synthetic polypeptide
GTAEAASASGTTGRAGTATNLPPEGLTGPPGSP

SEQ ID NO: 568 - protein, 33 aa, Artificial Sequence
  Description of Artificial Sequence: Synthetic polypeptide
GTAEAASASGTTGRAGGAANLAPTGLTEPPGSP

SEQ ID NO: 569 - protein, 33 aa, Artificial Sequence
  Description of Artificial Sequence: Synthetic polypeptide
GTAEAASASGTTGRAGTAENLAPSGLTTPPGSP

SEQ ID NO: 570 - protein, 33 aa, Artificial Sequence
  Description of Artificial Sequence: Synthetic polypeptide
GTAEAASASGTTGRAGSATNLGPGGLTGPPGSP

SEQ ID NO: 571 - protein, 33 aa, Artificial Sequence
  Description of Artificial Sequence: Synthetic polypeptide
GTAEAASASGTTARAGGAENLTPAGLTEPPGSP

SEQ ID NO: 572 - protein, 33 aa, Artificial Sequence
  Description of Artificial Sequence: Synthetic polypeptide
GTAEAASASGTTARAGSAENLSPSGLTGPPGSP

SEQ ID NO: 573 - protein, 33 aa, Artificial Sequence
  Description of Artificial Sequence: Synthetic polypeptide
GTAEAASASGTTARAGGAGNLAPEGLTTPPGSP

SEQ ID NO: 574 - protein, 33 aa, Artificial Sequence
  Description of Artificial Sequence: Synthetic polypeptide
GTAEAASASGTTSRAGAAENLTPTGLTGPPGSP

SEQ ID NO: 575 - protein, 33 aa, Artificial Sequence
  Description of Artificial Sequence: Synthetic polypeptide
GTAEAASASGTYGRTTTPGNEPPASLEAEPGSP

SEQ ID NO: 576 - protein, 33 aa, Artificial Sequence
  Description of Artificial Sequence: Synthetic polypeptide
GTAEAASASGTYSRGESGPNEPPPGLTGPPGSP

SEQ ID NO: 577 - protein, 33 aa, Artificial Sequence
  Description of Artificial Sequence: Synthetic polypeptide
GTAEAASASGAWGRTGASENETPAPLGGEPGSP

SEQ ID NO: 578 - protein, 33 aa, Artificial Sequence
  Description of Artificial Sequence: Synthetic polypeptide
GTAEAASASGRWGRAETTPNTPPEGLETEPGSP

SEQ ID NO: 579 - protein, 33 aa, Artificial Sequence
  Description of Artificial Sequence: Synthetic polypeptide
GTAEAASASGESGRAANHTGAEPPELGAGPGSP

SEQ ID NO: 580 - protein, 33 aa, Artificial Sequence
  Description of Artificial Sequence: Synthetic polypeptide
GTAEAASASGTTGRAGEAANLTPAGLTESPGSP

SEQ ID NO: 581 - protein, 33 aa, Artificial Sequence
  Description of Artificial Sequence: Synthetic polypeptide
GTAEAASASGTTGRAGEAANLTPAALTESPGSP

SEQ ID NO: 582 - protein, 33 aa, Artificial Sequence
  Description of Artificial Sequence: Synthetic polypeptide
GTAEAASASGTTGRAGEAANLTPAPLTESPGSP

SEQ ID NO: 583 - protein, 33 aa, Artificial Sequence
  Description of Artificial Sequence: Synthetic polypeptide
GTAEAASASGTTGRAGEAANLTPEPLTESPGSP

SEQ ID NO: 584 - protein, 33 aa, Artificial Sequence
  Description of Artificial Sequence: Synthetic polypeptide
GTAEAASASGTTGRAGEAANLTPAGLTGAPGSP

SEQ ID NO: 585 - protein, 33 aa, Artificial Sequence
  Description of Artificial Sequence: Synthetic polypeptide
GTAEAASASGTTGRAGEAANLTPEGLTGAPGSP

SEQ ID NO: 586 - protein, 33 aa, Artificial Sequence
  Description of Artificial Sequence: Synthetic polypeptide
GTAEAASASGTTGRAGEAANLTPEPLTGAPGSP

SEQ ID NO: 587 - protein, 33 aa, Artificial Sequence
  Description of Artificial Sequence: Synthetic polypeptide
GTAEAASASGTTGRAGEAANLTPAGLTEAPGSP

SEQ ID NO: 588 - protein, 33 aa, Artificial Sequence
  Description of Artificial Sequence: Synthetic polypeptide
GTAEAASASGTTGRAGEAANLTPEGLTEAPGSP

SEQ ID NO: 589 - protein, 33 aa, Artificial Sequence
  Description of Artificial Sequence: Synthetic polypeptide
GTAEAASASGTTGRAGEAANLTPAPLTEAPGSP

SEQ ID NO: 590 - protein, 33 aa, Artificial Sequence
  Description of Artificial Sequence: Synthetic polypeptide
GTAEAASASGTTGRAGEAANLTPEPLTEAPGSP

SEQ ID NO: 591 - protein, 33 aa, Artificial Sequence
  Description of Artificial Sequence: Synthetic polypeptide
GTAEAASASGTTGRAGEAANLTPEPLTGPPGSP

SEQ ID NO: 592 - protein, 33 aa, Artificial Sequence
  Description of Artificial Sequence: Synthetic polypeptide
GTAEAASASGTTGRAGEAANLTPAGLTGGPGSP

SEQ ID NO: 593 - protein, 33 aa, Artificial Sequence
  Description of Artificial Sequence: Synthetic polypeptide
GTAEAASASGTTGRAGEAANLTPEGLTGGPGSP

SEQ ID NO: 594 - protein, 33 aa, Artificial Sequence
  Description of Artificial Sequence: Synthetic polypeptide
GTAEAASASGTTGRAGEAANLTPEALTGGPGSP

SEQ ID NO: 595 - protein, 33 aa, Artificial Sequence
  Description of Artificial Sequence: Synthetic polypeptide
GTAEAASASGTTGRAGEAANLTPEPLTGGPGSP

SEQ ID NO: 596 - protein, 33 aa, Artificial Sequence
  Description of Artificial Sequence: Synthetic polypeptide
GTAEAASASGTTGRAGEAANLTPAGLTEGPGSP

SEQ ID NO: 597 - protein, 33 aa, Artificial Sequence
  Description of Artificial Sequence: Synthetic polypeptide
GTAEAASASGTTGRAGEAANLTPEGLTEGPGSP

SEQ ID NO: 598 - protein, 33 aa, Artificial Sequence
  Description of Artificial Sequence: Synthetic polypeptide
GTAEAASASGTTGRAGEAANLTPAPLTEGPGSP

SEQ ID NO: 599 - protein, 33 aa, Artificial Sequence
  Description of Artificial Sequence: Synthetic polypeptide
GTAEAASASGTTGRAGEAANLTPEPLTEGPGSP

SEQ ID NO: 600 - protein, 30 aa, Artificial Sequence
  Description of Artificial Sequence: Synthetic polypeptide
GTAEAASASGEAGRSAEATSAGATGPPGSP

SEQ ID NO: 601 - protein, 30 aa, Artificial Sequence
  Description of Artificial Sequence: Synthetic polypeptide
GTAEAASASGSASGTYSRGESGPGSPPGSP

SEQ ID NO: 602 - protein, 30 aa, Artificial Sequence
  Description of Artificial Sequence: Synthetic polypeptide
GTAEAASASGSASGEAGRTDTHPGSPPGSP

SEQ ID NO: 603 - protein, 30 aa, Artificial Sequence
  Description of Artificial Sequence: Synthetic polypeptide
GTAEAASASGSASGEPGRAAEHPGSPPGSP

SEQ ID NO: 604 - protein, 30 aa, Artificial Sequence
  Description of Artificial Sequence: Synthetic polypeptide
GTAEAASASGSPAGESSRGTTIAGSPPGSP

SEQ ID NO: 605 - protein, 30 aa, Artificial Sequence
  Description of Artificial Sequence: Synthetic polypeptide
GTAEAASASGEAGESAGATPAGLTGPPGSP

SEQ ID NO: 606 - protein, 30 aa, Artificial Sequence
  Description of Artificial Sequence: Synthetic polypeptide
GTAEAASASGSASGAPLELEAGPGSPPGSP

SEQ ID NO: 607 - protein, 30 aa, Artificial Sequence
  Description of Artificial Sequence: Synthetic polypeptide
GTAEAASASGSASGEPPELGAGPGSPPGSP

SEQ ID NO: 608 - protein, 30 aa, Artificial Sequence
  Description of Artificial Sequence: Synthetic polypeptide
GTAEAASASGSASGEPSGLTEGPGSPPGSP

SEQ ID NO: 609 - protein, 30 aa, Artificial Sequence
  Description of Artificial Sequence: Synthetic polypeptide
GTAEAASASGSASGTPAPLTEPPGSPPGSP

SEQ ID NO: 610 - protein, 30 aa, Artificial Sequence
  Description of Artificial Sequence: Synthetic polypeptide
GTAEAASASGSASGTPAELTEPPGSPPGSP

SEQ ID NO: 611 - protein, 30 aa, Artificial Sequence
  Description of Artificial Sequence: Synthetic polypeptide
GTAEAASASGSASGPPPGLTGPPGSPPGSP

SEQ ID NO: 612 - protein, 30 aa, Artificial Sequence
  Description of Artificial Sequence: Synthetic polypeptide
GTAEAASASGSASGTPAPLGGEPGSPPGSP

SEQ ID NO: 613 - protein, 30 aa, Artificial Sequence
  Description of Artificial Sequence: Synthetic polypeptide
GTAEAASASGSPAGAPEGLTGPAGSPPGSP

SEQ ID NO: 614 - protein, 30 aa, Artificial Sequence
  Description of Artificial Sequence: Synthetic polypeptide
GTAEAASASGSPAGPPEGLETEAGSPPGSP

SEQ ID NO: 615 - protein, 30 aa, Artificial Sequence
  Description of Artificial Sequence: Synthetic polypeptide
GTAEAASASGSPTSGQGGLTGPGSEPPGSP

SEQ ID NO: 616 - protein, 30 aa, Artificial Sequence
  Description of Artificial Sequence: Synthetic polypeptide
GTAEAASASGSESAPPEGLETESTEPPGSP

SEQ ID NO: 617 - protein, 30 aa, Artificial Sequence
  Description of Artificial Sequence: Synthetic polypeptide
GTAEAASASGSEGSEPLELGAASETPPGSP

SEQ ID NO: 618 - protein, 30 aa, Artificial Sequence
  Description of Artificial Sequence: Synthetic polypeptide
GTAEAASASGSEGSGPAGLEAPSETPPGSP

SEQ ID NO: 619 - protein, 30 aa, Artificial Sequence
  Description of Artificial Sequence: Synthetic polypeptide
GTAEAASASGSEPTPPASLEAEPGSPPGSP

SEQ ID NO: 620 - protein, 119 aa, Artificial Sequence [sequence omitted]

SEQ ID NO: 621 - protein, 122 aa, Artificial Sequence [sequence omitted]

SEQ ID NO: 622 - protein, 119 aa, Artificial Sequence
  Description of Artificial Sequence: Synthetic polypeptide
QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSS

SEQ ID NO: 623 - protein, 119 aa, Artificial Sequence [sequence omitted]

SEQ ID NO: 624 - protein, 119 aa, Artificial Sequence
  Description of Artificial Sequence: Synthetic polypeptide
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 625 - protein, 119 aa, Artificial Sequence
  Description of Artificial Sequence: Synthetic polypeptide
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 626 - protein, 125 aa, Artificial Sequence
  Description of Artificial Sequence: Synthetic polypeptide
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 627 - protein, 125 aa, Artificial Sequence
  Description of Artificial Sequence: Synthetic polypeptide
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 628 - protein, 125 aa, Artificial Sequence
  Description of Artificial Sequence: Synthetic polypeptide
EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 629 - protein, 125 aa, Artificial Sequence
  Description of Artificial Sequence: Synthetic polypeptide
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS

SEQ ID NO: 630 - protein, 107 aa, Artificial Sequence
  Description of Artificial Sequence: Synthetic polypeptide
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 631 - protein, 107 aa, Artificial Sequence [sequence omitted]

SEQ ID NO: 632 - protein, 107 aa, Artificial Sequence
  Description of Artificial Sequence: Synthetic polypeptide
DIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITR

SEQ ID NO: 633 - protein, 107 aa, Artificial Sequence
  Description of Artificial Sequence: Synthetic polypeptide
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 634 - protein, 106 aa, Artificial Sequence
  Description of Artificial Sequence: Synthetic polypeptide
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 635 - protein, 106 aa, Artificial Sequence
  Description of Artificial Sequence: Synthetic polypeptide
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 636 - protein, 109 aa, Artificial Sequence
  Description of Artificial Sequence: Synthetic polypeptide
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 637 - protein, 109 aa, Artificial Sequence
  Description of Artificial Sequence: Synthetic polypeptide
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 638 - protein, 109 aa, Artificial Sequence
  Description of Artificial Sequence: Synthetic polypeptide
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 639 - protein, 109 aa, Artificial Sequence
  Description of Artificial Sequence: Synthetic polypeptide
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 640 - protein, 123 aa, Artificial Sequence [sequence omitted]

SEQ ID NO: 641 - protein, 122 aa, Artificial Sequence
  Description of Artificial Sequence: Synthetic polypeptide
EVQLVESGGGLVQPGGSLRLSCAASGFTFSSYDIHWVRQATGKGLEWVSAIGPAGDTYYPGSVKGRFTISRENAKNSLYLQMNSLRAGDTAVYYCARGLITFGGLIAPFDYWGQGTLVTVSS

SEQ ID NO: 642 - protein, 120 aa, Artificial Sequence
  Description of Artificial Sequence: Synthetic polypeptide
QVKLEQSGAEVVKPGASVKLSCKASGFNIKDSYMHWLRQGPGQRLEWIGWIDPENGDTEYAPKFQGKATFTTDTSANTAYLGLSSLRPEDTAVYYCNEGTPTGPYYFDYWGQGTLVTVSS

SEQ ID NO: 643 - protein, 121 aa, Artificial Sequence
  Description of Artificial Sequence: Synthetic polypeptide
EVQLVESGGGLVQPGGSLRLSCAASGFNIKDTYMHWVRQAPGKGLEWVARIDPANGNSKYADSVKGRFTISADTSKNTAYLQMNSLRAEDTAVYYCAPFGYYVSDYAMAYWGQGTLVTVSS

SEQ ID NO: 644 - protein, 121 aa, Artificial Sequence
  Description of Artificial Sequence: Synthetic polypeptide
EVQLVESGGGLVQPGGSLRLSCAASGFNIKDTYMHWVRQAPGKGLEWVARIDPANGNSKYVPKFQGRATISADTSKNTAYLQMNSLRAEDTAVYYCAPFGYYVSDYAMAYWGQGTLVTVSS

SEQ ID NO: 645 - protein, 119 aa, Artificial Sequence
  Description of Artificial Sequence: Synthetic polypeptide
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSS

SEQ ID NO: 646 - protein, 121 aa, Artificial Sequence
  Description of Artificial Sequence: Synthetic polypeptide
EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSS

SEQ ID NO: 647 - protein, 121 aa, Artificial Sequence
  Description of Artificial Sequence: Synthetic polypeptide
EVQLVESGGGLVQPGRSLRLSCAASGFTVSSYWMHWVRQAPGKGLEWVGFIRNKANGGTTEYAASVKGRFTISRDDSKNTLYLQMNSLRAEDTAVYYCARDRGLRFYFDYWGQGTTVTVSS

SEQ ID NO: 648 - protein, 124 aa, Artificial Sequence
  Description of Artificial Sequence: Synthetic polypeptide
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSS

SEQ ID NO: 649 - protein, 122 aa, Artificial Sequence
  Description of Artificial Sequence: Synthetic polypeptide
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSS

SEQ ID NO: 650 - protein, 122 aa, Artificial Sequence
  Description of Artificial Sequence: Synthetic polypeptide
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSG

SEQ ID NO: 651 - protein, 119 aa, Artificial Sequence
  Description of Artificial Sequence: Synthetic polypeptide
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSS

SEQ ID NO: 652 - protein, 122 aa, Artificial Sequence [sequence omitted]

SEQ ID NO: 653 - protein, 121 aa, Artificial Sequence [sequence omitted]

SEQ ID NO: 654 - protein, 122 aa, Artificial Sequence [sequence omitted]

SEQ ID NO: 655 - protein, 114 aa, Artificial Sequence
  Description of Artificial Sequence: Synthetic polypeptide
QLVQSGAEVKKPGSSVKVSCKASGYTITDSNIHWVRQAPGQSLEWIGYIYPYNGGTDYNQKFKNRATLTVDNPTNTAYMELSSLRSEDTDFYYCVNGNPWLAYWGQGTLVTVSS

SEQ ID NO: 656 - protein, 122 aa, Artificial Sequence [sequence omitted]

SEQ ID NO: 657 - protein, 118 aa, Artificial Sequence
  Description of Artificial Sequence: Synthetic polypeptide
QIQLVQSGPEVKKPGETVKISCKASGYTFTNYGMNWVKQAPGKGLKWMGWINTYTGEPTYADAFKGRFAFSLETSASTAYLQINNLKNEDTATYFCARDYGDYGMDYWGQGTSVTVSS

SEQ ID NO: 658 - protein, 118 aa, Artificial Sequence
  Description of Artificial Sequence: Synthetic polypeptide
QVQLQQSGTELMTPGASVTMSCKTSGYTFSTYWIEWVKQRPGHGLEWIGEILGPSGYTDYNEKFKAKATFTADTSSNTAYMQLSSLASEDSAVYYCARWDRLYAMDYWGGGTSVTVSS

SEQ ID NO: 659 - protein, 118 aa, Artificial Sequence
  Description of Artificial Sequence: Synthetic polypeptide
QVQLVESGGGVVQPGRSLRLSCAASGFTFSSYIMHWVRQAPGKGLEWVAVISYDGRNKYYADSVKGRFTISRDNSKNTLYLQMNSLRAEDTAVYYCARDTDGYDFDYWGQGTLVTVSS

SEQ ID NO: 660 - protein, 119 aa, Artificial Sequence
  Description of Artificial Sequence: Synthetic polypeptide
QIQLVESGGGVVQPGRSLRLSCAASGFTFGYYAMHWVRQAPGKGLEWVAVISYDGSIKYYADSVKGRFTISRDNSKNTLYLQMNSLRAEDTAVYYCAREGPYSNYLDYWGQGTLVTVSS

SEQ ID NO: 661 - protein, 118 aa, Artificial Sequence
  Description of Artificial Sequence: Synthetic polypeptide
QVQLVESGGGVVQPGRSLRLSCATSGFTFSDYGMHWVRQAPGKGLEWVAVIWYDGSNKYYADSVKGRFTISRDNSKKTLSLQMNSLRAEDTAVYYCARDSIMVRGDYWGQGTLVTVSS

SEQ ID NO: 662 - protein, 118 aa, Artificial Sequence
  Description of Artificial Sequence: Synthetic polypeptide
QVQLVESGGGVVQPGRSLRLSCAASGFTFSDHGMHWVRQAPGKGLEWVAVIWYDGSNKYYADSVKGRFTISRDNSKNTLYLQMNSLRAEDTAVYYCARDSIMVRGDYWGQGTLVTVSS

SEQ ID NO: 663 - protein, 122 aa, Artificial Sequence
  Description of Artificial Sequence: Synthetic polypeptide
QVQLQESGPGLVKPSETLSLTCTVSGGSVSSDYYYWSWIRQPPGKGLEWLGYIYYSGSTNYNPSLKSRVTISVDTSKNQFSLKLRSVTTADTAVYYCARGDGDYGGNCFDYWGQGTLVTVSS

SEQ ID NO: 664 - protein, 117 aa, Artificial Sequence
  Description of Artificial Sequence: Synthetic polypeptide
QVQLVQSGAEVKKPGASVKVSCKASGYTFTSYGFSWVRQAPGQGLEWMGWISASNGNTYYAQKLQGRVTMTTDTSTSTAYMELRSLRSDDTAVYYCARVYADYADYWGQGTLVTVSS

SEQ ID NO: 665 - protein, 115 aa, Artificial Sequence [sequence omitted]

SEQ ID NO: 666 - protein, 119 aa, Artificial Sequence [sequence omitted]

SEQ ID NO: 667 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSS

SEQ ID NO: 668 - protein, 118 aa, Artificial Sequence
  Description of Artificial Sequence: Synthetic polypeptide
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSS

SEQ ID NO: 669 - protein, 123 aa, Artificial Sequence
  Description of Artificial Sequence: Synthetic polypeptide
QVQLQESGPGLVKPSQTLSLTCTVSGGSISSGGYYWSWIRQHPGKGLEWIGIIYYSGSTYYNPSLKSRVTISVDTSKNQFSLKLNSVTAADTAVFYCARVAIVTTIPGGMDVWGQGTTVTVSS

SEQ ID NO: 670 - protein, 120 aa, Artificial Sequence
  Description of Artificial Sequence: Synthetic polypeptide
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSS

SEQ ID NO: 671 - protein, 127 aa, Artificial Sequence
  Description of Artificial Sequence: Synthetic polypeptide
EVQLLESGGGVVQPGRSLRLSCAASGFTFSSYGMHWVRQAPGKGLEWVAVISYDGSNKYYADSVKGRFTISRDNSKNTLYLQMNSLRAEDTAVYYCAKDMGWGSGWRPYYYYGMDVWGQGTTVTVSS

SEQ ID NO: 672 - protein, 116 aa, Artificial Sequence
  Description of Artificial Sequence: Synthetic polypeptide
QVQLQQSGAELVRPGTSVKVSCKASGYAFTNYLIEWVKQRPGQGLEWIGVINPGSGGTNYNEKFKGKATLTADKSSSTAYMQLSSLTSDDSAVYFCARDGPWFAYWGQGTLVTVSA

SEQ ID NO: 673 - protein, 116 aa, Artificial Sequence
  Description of Artificial Sequence: Synthetic polypeptide
QIQLVQSGPELKKPGETVKISCKASGYTFTNYGMNWVRQAPGKGLKWMGWINTYTGEPTYADDFKGRFVFSLETSASTAFLQLNNLRSEDTATYFCVRFISKGDYWGQGTSVTVSS

SEQ ID NO: 674 - protein, 114 aa, Artificial Sequence
  Description of Artificial Sequence: Synthetic polypeptide
VQLQQSDAELVKPGASVKISCKASGYTFTDHAIHWVKQNPEQGLEWIGYFSPGNDDFKYNERFKGKATLTADKSSSTAYVQLNSLTSEDSAVYFCTRSLNMAYWGQGTSVTVSS

SEQ ID NO: 675 - protein, 116 aa, Artificial Sequence
  Description of Artificial Sequence: Synthetic polypeptide
EVQLVQSGPEVKKPGASVKVSCKASGYTFTNYGMNWVRQAPGQGLEWMGWINTYTGEPTYGEDFKGRFAFSLDTSASTAYMELSSLRSEDTAVYFCARFGNYVDYWGQGSLVTVSS

SEQ ID NO: 676 - protein, 116 aa, Artificial Sequence
  Description of Artificial Sequence: Synthetic polypeptide
EVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 677 - protein, 116 aa, Artificial Sequence; identical to SEQ ID NO: 676
  Description of Artificial Sequence: Synthetic polypeptide

SEQ ID NO: 678 - protein, 128 aa, Artificial Sequence
  Description of Artificial Sequence: Synthetic polypeptide
EVQLLESGGGLVQPGGSLRLSCAASGFTFSHYMMAWVRQAPGKGLEWVSRIGPSGGPTHYADSVKGRFTISRDNSKNTLYLQMNSLRAEDTAVYYCAGYDSGYDYVAVAGPAEYFQHWGQGTLVTVSS

SEQ ID NO: 679 - protein, 119 aa, Artificial Sequence
  Description of Artificial Sequence: Synthetic polypeptide
EVQLVESGGGVVQPGRSLRLSCSASGFTFSGYGLSWVRQAPGKGLEWVAMISSGGSYTYYADSVKGRFAISRDNAKNTLFLQMDSLRPEDTGVYFCARHGDDPAWFAYWGQGTPVTVSS

SEQ ID NO: 680 - protein, 118 aa, Artificial Sequence
  Description of Artificial Sequence: Synthetic polypeptide
QVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSS

SEQ ID NO: 681 - protein, 118 aa, Artificial Sequence; identical to SEQ ID NO: 680
  Description of Artificial Sequence: Synthetic polypeptide

SEQ ID NO: 682 - protein, 109 aa, Artificial Sequence
  Description of Artificial Sequence: Synthetic polypeptide
GPELVKPGASVKISCKASDYSFTGYFMNWVMQSHGKSLEWIGRIFPYNGDTFYNQKFKGRATLTVDKSSSTAHMELRSLASEDSAVYFCARGTHYFDYWGQGTTLTVSS

SEQ ID NO: 683 - protein, 115 aa, Artificial Sequence
  Description of Artificial Sequence: Synthetic polypeptide
QVQLVQSGAEVKKPGASVKVSCKASGYTFTDYEMHWVRQAPGQGLEWMGALDPKTGDTAYSQKFKGRVTLTADKSTSTAYMELSSLTSEDTAVYYCTRFYSYTYWGQGTLVTVSS

SEQ ID NO: 684 - protein, 117 aa, Artificial Sequence
  Description of Artificial Sequence: Synthetic polypeptide
EVQLVQSGAEVKKPGESLKISCKGSGYSFTSYWIAWVRQMPGKGLEWMGIIFPGDSDTRYSPSFQGQVTISADRSIRTAYLQWSSLKASDTALYYCARTREGYFDYWGQGTLVTVSS

SEQ ID NO: 685 - protein, 117 aa, Artificial Sequence
  Description of Artificial Sequence: Synthetic polypeptide
EVQLVQSGAEVKKPGESLKISCKGSGYSFTNYWIAWVRQMPGKGLEWMGIIYPGDSDTRYSPSFQGQVTISADKSIRTAYLQWSSLKASDTAMYYCARTREGYFDYWGQGTLVTVSS

SEQ ID NO: 686 - protein, 117 aa, Artificial Sequence
  Description of Artificial Sequence: Synthetic polypeptide
EVQLVQSGADVTKPGESLKISCKVSGYRFTNYWIGWMRQMSGKGLEWMGIIYPGDSDTRYSPSFQGHVTISADKSINTAYLRWSSLKASDTAIYYCARTREGFFDYWGQGTPVTVSS

SEQ ID NO: 687 - protein, 124 aa, Artificial Sequence
  Description of Artificial Sequence: Synthetic polypeptide
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSS

SEQ ID NO: 688 - protein, 119 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSA

SEQ ID NO: 689 - protein, 120 aa, Artificial Sequence [sequence omitted]

SEQ ID NO: 690 - protein, 125 aa, Artificial Sequence [sequence omitted]

SEQ ID NO: 691 - protein, 121 aa, Artificial Sequence [sequence omitted]

SEQ ID NO: 692 - protein, 121 aa, Artificial Sequence
  Description of Artificial Sequence: Synthetic polypeptide
QVQLVQSGAEVKKPGSSVKVSCKASGGTFSSYAISWVRQAPGQGLEWMGSIIPIFGTVNYAQKFQGRVTITADESTSTAYMELSSLRSEDTAVYYCARDPSVNLYWYFDLWGRGTLVTVSS

SEQ ID NO: 693 - protein, 119 aa, Artificial Sequence
  Description of Artificial Sequence: Synthetic polypeptide
QVQLVQSGAEVKKPGSSVKVSCKASGGTFGSYAISWVRQAPGQGLEWMGSIIPIFGAANPAQKSQGRVTITADESTSTAYMELSSLRSEDTAVYYCAKMGRGKVAFDIWGQGTMVTVSS

SEQ ID NO: 694 - protein, 123 aa, Artificial Sequence
  Description of Artificial Sequence: Synthetic polypeptide
QVQLVQSGAEVKKPGASVKVSCKASGYAFTSYGINWVRQAPGQGLEWMGWISAYNGNTYYAQKLRGRVTMTTDTSTSTAYMELRSLRSDDTAVYYCARDLGGYGSGSVPFDPWGQGTLVTVSS

SEQ ID NO: 695 - protein, 123 aa, Artificial Sequence [sequence omitted]

SEQ ID NO: 696 - protein, 119 aa, Artificial Sequence [sequence omitted]

SEQ ID NO: 697 - protein, 118 aa, Artificial Sequence
  Description of Artificial Sequence: Synthetic polypeptide
QIQLVQSGPELKKPGETVKISCKASGYTFTEYPIHWVKQAPGKGFKWMGMIYTDIGKPTYAEEFKGRFAFSLETSASTAYLQINNLKNEDTATYFCVRDRYDSLFDYWGQGTTLTVSS

SEQ ID NO: 698 - protein, 121 aa, Artificial Sequence
  Description of Artificial Sequence: Synthetic polypeptide
EMQLVESGGGFVKPGGSLKLSCAASGFAFSHYDMSWVRQTPKQRLEWVAYIASGGDITYYADTVKGRFTISRDNAQNTLYLQMSSLKSEDTAMFYCSRSSYGNNGDALDFWGQGTSVTVSS

SEQ ID NO: 699 - protein, 119 aa, Artificial Sequence
  Description of Artificial Sequence: Synthetic polypeptide
QVQLVESGGGLVQPGGSLRLSCAASGFTFSSYAMGWVRQAPGKGLEWVSSISGSSRYIYYADSVKGRFTISRDNSKNTLYLQMNSLRAEDTAVYYCAKMDASGSYFNFWGQGTLVTVSS

SEQ ID NO: 700 - protein, 115 aa, Artificial Sequence
  Description of Artificial Sequence: Synthetic polypeptide
QVQLLQSAAEVKKPGESLKISCKGSGYSFTSYWIGWVRQMPGKGLEWMGIIYPGDSDTRYSPSFQGQVTISADKSISTAYLQWSSLKASDTAVYYCARWRDSPLWGQGTLVTVSS

SEQ ID NO: 701 - protein, 120 aa, Artificial Sequence [sequence omitted]

SEQ ID NO: 702 - protein, 120 aa, Artificial Sequence
  Description of Artificial Sequence: Synthetic polypeptide
QVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSS

SEQ ID NO: 703 - protein, 119 aa, Artificial Sequence
  Description of Artificial Sequence: Synthetic polypeptide
QVQLVESGGGLVQPGGSLRLSCAASGFTFRSYAMSWVRQAPGKGLEWVSAISGRGDNTYYADSVKGRFTISRDNSKNTLYLQMNSLRAEDTAVYYCAKMTSNAFAFDYWGQGTLVTVSS

SEQ ID NO: 704 - protein, 119 aa, Artificial Sequence [sequence omitted]

SEQ ID NO: 705 - protein, 119 aa, Artificial Sequence [sequence omitted]

SEQ ID NO: 706 - protein, 121 aa, Artificial Sequence [sequence omitted]

SEQ ID NO: 707 - protein, 118 aa, Artificial Sequence
  Description of Artificial Sequence: Synthetic polypeptide
QVQLQESGGGLVKPGGSLRLSCAASGFTFSSYWMSWVRQAPGKGLEWVANINRDGSASYYVDSVKGRFTISRDDAKNSLYLQMNSLRAEDTAVYYCARDRGVGYFDLWGRGTLVTVSS

SEQ ID NO: 708 - protein, 129 aa, Artificial Sequence
  Description of Artificial Sequence: Synthetic polypeptide
QVQLVQSGAEVKKPGESLKISCKGSGYSFTSYWIAWVRQMPGKGLEYMGLIYPGDSDTKYSPSFQGQVTISVDKSVSTAYLQWSSLKPSDSAVYFCARHDVGYCTDRTCAKWPEWLGVWGQGTLVTVSS

SEQ ID NO: 709 - protein, 119 aa, Artificial Sequence
  Description of Artificial Sequence: Synthetic polypeptide
EVQLVESGGGVVQPGRSLRLSCSTSGFTFSDYYMYWVRQAPGKGLEWVAYMSNVGAITDYPDTVKGRFTISRDNSKNTLFLQMDSLRPEDTGVYFCARGTRDGSWFAYWGQGTPVTVSS

SEQ ID NO: 710 - protein, 120 aa, Artificial Sequence
  Description of Artificial Sequence: Synthetic polypeptide
QVELVQSGAEVKKPGESLKISCKGSGYSFTSYWIGWVRQAPGKGLEWMGIIDPGDSRTRYSPSFQGQVTISADKSISTAYLQWSSLKASDTAMYYCARGQLYGGTYMDGWGQGTLVTVSS

SEQ ID NO: 711 - protein, 119 aa, Artificial Sequence
  Description of Artificial Sequence: Synthetic polypeptide
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGQGTTVTVSS

SEQ ID NO: 712 - protein, 122 aa, Artificial Sequence
  Description of Artificial Sequence: Synthetic polypeptide
QVYLVESGGGVVQPGRSLRLSCAASGITFSIYGMHWVRQAPGKGLEWVAVIWYDGSHEYYADSVKGRFTISRDNSKNTLYLLMNSLRAEDTAVYYCARDGDYYDSGSPLDYWGQGTLVTVSS

SEQ ID NO: 713 - protein, 122 aa, Artificial Sequence
  Description of Artificial Sequence: Synthetic polypeptide
QVHLVESGGGVVQPGRSLRLSCVASGITFRIYGMHWVRQAPGKGLEWVAVLWYDGSHEYYADSVKGRFTISRDNSKNTLYLQMNSLRAEDTAIYYCARDGDYYDSGSPLDYWGQGTLVTVSS

SEQ ID NO: 714 - protein, 131 aa, Artificial Sequence
  Description of Artificial Sequence: Synthetic polypeptide
EVHLVESGGGLVQPGGSLRLSCAASGFTFSRYWMSWVRQAQGKGLEWVASIKQAGSEKTYVDSVKGRFTISRDNAKNSLSLQMNSLRAEDTAVYYCAREGAYYYDSASYYPYYYYYSMDVWGQGTTVTVSS

SEQ ID NO: 715 - protein, 119 aa, Artificial Sequence
  Description of Artificial Sequence: Synthetic polypeptide
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGSGTPVTVSS

SEQ ID NO: 716 - protein, 119 aa, Artificial Sequence
  Description of Artificial Sequence: Synthetic polypeptide
EVQLQESGPELVKPGASVKMSCKASGYTFPSYVLHWVKQKPGQGLEWIGYINPYNDGTQYNEKFKGKATLTSDKSSSTAYMELSRLTSEDSAVYYCARGFGGSYGFAYWGQGTLITVSA

SEQ ID NO: 717 - protein, 119 aa, Artificial Sequence
  Description of Artificial Sequence: Synthetic polypeptide
QVQLQQSGAEVKKFGASVKVSCEASGYTFPSYVLHWVKQAPGQGLEWIGYINPYNDGTQTNKKFKGKATLTRDTSINTAYMELSRLRSDDTAVYYCARGFGGSYGFAYNGQGTLVTVSS

SEQ ID NO: 718 - protein, 117 aa, Artificial Sequence
  Description of Artificial Sequence: Synthetic polypeptide
QAQLQVSGAEVVKPGASVKMSCKASGYTFTSYNMHWVKQTPGQGLEWIGYIYPGNGATNYNQKFQGKATLTADTSSSTAYMQISSLTSEDSAVYFCARGDSVPFAYWGQGTLVTVSA

SEQ ID NO: 719 - protein, 118 aa, Artificial Sequence
  Description of Artificial Sequence: Synthetic polypeptide
QVQLQQSGAELMKPGASVKISCKATGYTFSAYWIEWVKQRPGHGLEWIGEILPGSNNSRYNEKFKGKATFTADTSSNTAYMQLSSLTSEDSAVYYCSRSYDFAWFAYWGQGTPVTVSA

SEQ ID NO: 720 - protein, 118 aa, Artificial Sequence
  Description of Artificial Sequence: Synthetic polypeptide
QVQLVQSGAEVKKPGASVKVSCKASGYTFSAYWIEWVRQAPGKGLEWVGEILPGSNNSRYNEKFKGRVTVTRDTSTNTAYMELSSLRSEDTAVYYCARSYDFAWFAYWGQGTLVTVSS

SEQ ID NO: 721 - protein, 123 aa, Artificial Sequence
  Description of Artificial Sequence: Synthetic polypeptide
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 722 - protein, 121 aa, Artificial Sequence
  Description of Artificial Sequence: Synthetic polypeptide
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 723 - protein, 118 aa, Artificial Sequence [sequence omitted]

SEQ ID NO: 724 - protein, 120 aa, Artificial Sequence
  Description of Artificial Sequence: Synthetic polypeptide
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS

SEQ ID NO: 725 - protein, 115 aa, Artificial Sequence
  Description of Artificial Sequence: Synthetic polypeptide
EVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSS

SEQ ID NO: 726 - protein, 121 aa, Artificial Sequence
  Description of Artificial Sequence: Synthetic polypeptide
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSS

SEQ ID NO: 727 - protein, 121 aa, Artificial Sequence
  Description of Artificial Sequence: Synthetic polypeptide
QEQLVESGGRLVTPGGSLTLSCKASGFDFSAYYMSWVRQAPGKGLEWIATIYPSSGKTYYATWVNGRFTISSDNAQNTVDLQMNSLTAADRATYFCARDSYADDGALFNIWGPGTLVTISS

SEQ ID NO: 728 - protein, 119 aa, Artificial Sequence
  Description of Artificial Sequence: Synthetic polypeptide
EVKLVESGGGLVKPGGSLKLSCAASGFTFSSYAMSWVRQIPEKRLEWVASISRGGTTYYPDSVKGRFTISRDNVRNILYLQMSSLRSEDTAMYYCGRYDYDGYYAMDYWGQGTSVTVSS

SEQ ID NO: 729 - protein, 117 aa, Artificial Sequence
  Description of Artificial Sequence: Synthetic polypeptide
QSLEESGGRLVTPGTPLTLTCTVSGIDLNSHWMSWVRQAPGKGLEWIGIIAASGSTYYANWAKGRFTISKTSTTVDLRIASPTTEDTATYFCARDYGDYRLVTFNIWGPGTLVTVSS

SEQ ID NO: 730 - protein, 116 aa, Artificial Sequence
  Description of Artificial Sequence: Synthetic polypeptide
QSVKESEGDLVTPAGNLTLTCTASGSDINDYPISWVRQAPGKGLEWIGFINSGGSTWYASWVKGRFTISRTSTTVDLKMTSLTTDDTATYFCARGYSTYYCDFNIWGPGTLVTISS

SEQ ID NO: 731 - protein, 115 aa, Artificial Sequence
  Description of Artificial Sequence: Synthetic polypeptide
QVQLVQSGAEVVKPGASVKISCKASGYTFTDHAIHWVKQNPGQRLEWIGYFSPGNDDFKYNERFKGKATLTADTSASTAYVELSSLRSEDTAVYFCTRSLNMAYWGQGTLVTVSS

SEQ ID NO: 732 - protein, 119 aa, Artificial Sequence
  Description of Artificial Sequence: Synthetic polypeptide
  MOD_RES (68)..(68): Any amino acid
QIQLVQSGPELKKPGETVKISCKASGYTFTNFGMNWVKQGPGEGLKWMGWINTNTGEPRYAEEFKGRXAFSLETTASTAYLQINNLKNEDTATYFCARDWDGAYFFDYWGQGTTLTVSS

SEQ ID NO: 733 - protein, 117 aa, Artificial Sequence
  Description of Artificial Sequence: Synthetic polypeptide
QVQLQQSRPELVKPGASVKMSCKASGYTFTDYVISWVKQRTGQGLEWIGEIYPGSNSIYYNEKFKGRATLTADKSSSTAYMQLSSLTSEDSAVYFCAMGGNYGFDYWGQGTTLTVSS

SEQ ID NO: 734 - protein, 122 aa, Artificial Sequence
  Description of Artificial Sequence: Synthetic polypeptide
  MOD_RES (97)..(97): Any amino acid
EVQLVESGGGLVQPKGSLKLSCAASGFTFNTYAMNWVRQAPGKGLEWVARIRSKSNNYATYYADSVKDRFTISRDDSQSMLYLQMNNLKTEDTAMYXCVRQWDYDVRAMNYWGQGTSVTVSS

SEQ ID NO: 735 - protein, 121 aa, Artificial Sequence
  Description of Artificial Sequence: Synthetic polypeptide
QVQLQQSGSELKKPGASVKVSCKASGYTFTNYGMNWVKQAPGQGLKWMGWINTYTGEPTYTDDFKGRFAFSLDTSVSTAYLQISSLKADDTAVYFCARGGFGSSYWYFDVWGQGSLVTVSS

SEQ ID NO: 736 - protein, 126 aa, Artificial Sequence
  Description of Artificial Sequence: Synthetic polypeptide
QAQVVESGGGVVQSGRSLRLSCAASGFAFSSYGMHWVRQAPGKGLEWVAVIWYDGSNKYYADSVRGRFTISRDNSENTLYLQMNSLRAEDTAVYYCARDHYGSGVHHYFYYGLDVWGQGTTVTVSS

SEQ ID NO: 737 - protein, 117 aa, Artificial Sequence
  Description of Artificial Sequence: Synthetic polypeptide
EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSA

SEQ ID NO: 738 - protein, 117 aa, Artificial Sequence
  Description of Artificial Sequence: Synthetic polypeptide
EVQLVESGGGLVQPGGSLRLSCAASGFTFSSYGMSWVRQAPGKGLEWVATITSGGSYTYYVDSVKGRFTISRDNAKNTLYLQMNSLRAEDTAVYYCVRIGEDALDYWGQGTLVTVSS

SEQ ID NO: 739 - protein, 118 aa, Artificial Sequence
  Description of Artificial Sequence: Synthetic polypeptide
KVQLQQSGTELVKPGASVKVSCKASGYIFTEYIIHWVKQRSGQGLEWIGWLYPESNIIKYNEKFKDKATLTADKSSSTVYMELSRLTSEDSAVYFCTRHDGTNFDYWGQGTTLTVSSA

SEQ ID NO: 740 - protein, 106 aa, Artificial Sequence [sequence omitted]

SEQ ID NO: 741 - protein, 107 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQHYDNSQTFGQGTKVEIK

SEQ ID NO: 742 - protein, 106 aa, Artificial Sequence
  Description of Artificial Sequence: Synthetic polypeptide
ENVLTQSPSSMSASVGDRVNIACSASSSVSYMHWFQQKPGKSPKLWIYSTSNLASGVPSRFSGSGSGTDYSLTISSMQPEDAATYYCQQRSSYPLTFGGGTKLEIK

SEQ ID NO: 743 - protein, 111 aa, Artificial Sequence
  Description of Artificial Sequence: Synthetic polypeptide
DIQLTQSPSSLSASVGDRVTITCRAGESVDIFGVGFLHWYQQKPGKAPKLLIYRASNLESGVPSRFSGSGSRTDFTLTISSLQPEDFATYYCQQTNEDPYTFGQGTKVEIK

SEQ ID NO: 744 - protein, 111 aa, Artificial Sequence; identical to SEQ ID NO: 743
  Description of Artificial Sequence: Synthetic polypeptide

SEQ ID NO: 745 - protein, 106 aa, Artificial Sequence
  Description of Artificial Sequence: Synthetic polypeptide
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIK

SEQ ID NO: 746 - protein, 107 aa, Artificial Sequence
  Description of Artificial Sequence: Synthetic polypeptide
QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIKR

SEQ ID NO: 747 - protein, 116 aa, Artificial Sequence
  Description of Artificial Sequence: Synthetic polypeptide
QAVLTQPASLSASPGASASLTCTLRRGINVGAYSIYWYQQKPGSPPQYLLRYKSDSDKQQGSGVSSRFSASKDASANAGILLISGLQSEDEADYYCMIWHSGASAVFGGGTKLTVL

SEQ ID NO: 748 - protein, 111 aa, Artificial Sequence
  Description of Artificial Sequence: Synthetic polypeptide
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 749 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 750 - protein, 106 aa, Artificial Sequence [sequence omitted]

SEQ ID NO: 751 - protein, 112 aa, Artificial Sequence
  Description of Artificial Sequence: Synthetic polypeptide
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIK

SEQ ID NO: 752 - protein, 106 aa, Artificial Sequence [sequence omitted]

SEQ ID NO: 753 - protein, 106 aa, Artificial Sequence [sequence omitted]

SEQ ID NO: 754 - protein, 106 aa, Artificial Sequence [sequence omitted]

SEQ ID NO: 755 - protein, 111 aa, Artificial Sequence [sequence omitted]

SEQ ID NO: 756 - protein, 107 aa, Artificial Sequence [sequence omitted]

SEQ ID NO: 757 - protein, 111 aa, Artificial Sequence
  Description of Artificial Sequence: Synthetic polypeptide
DIVLTQSPASLAVSLGQRATISCRASKSVSTSGYSFMHWYQQKPGQPPKLLIYLASNLESGVPARFSGSGSGTDFTLNIHPVEEEDAATYYCQHSREVPWTFGGGTKLEIK

SEQ ID NO: 758 - protein, 111 aa, Artificial Sequence
  Description of Artificial Sequence: Synthetic polypeptide
DIVLTQSPASLTVSLGQKTTISCRASKSVSTSGYSFMHWYQLKPGQSPKLLIYLASDLPSGVPARFSGSGSGTDFTLKIHPVEEEDAATYYCQHSREIPYTFGGGTKLEIT

SEQ ID NO: 759 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRTNWPLTFGGGTKVEIK

SEQ ID NO: 760 - protein, 107 aa, Artificial Sequence
  Description of Artificial Sequence: Synthetic polypeptide
AIQLTQSPSSLSASVGDRVTITCRASQGISSALAWYQQKPGKAPKFLIYDASSLESGVPSRFSGSGSGTDFTLTISSLQPEDFATYYCQQFNSYPFTFGPGTKVDIK

SEQ ID NO: 761 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 762 - protein, 107 aa, Artificial Sequence; identical to SEQ ID NO: 761
  Description of Artificial Sequence: Synthetic polypeptide

SEQ ID NO: 763 - protein, 107 aa, Artificial Sequence
  Description of Artificial Sequence: Synthetic polypeptide
EIVLTQSPATLSLSPGERATLSCRASQSVSSYLAWYQQKPGQAPRLLIFDASNRATGIPARFSGSGSGTDFTLTISSLEPEDFAVYYCQQRSNWPLTFGGGTKVEIK

SEQ ID NO: 764 - protein, 107 aa, Artificial Sequence
  Description of Artificial Sequence: Synthetic polypeptide
DIQMTQSPSSVSASVGDRVTITCRASQGINTWLAWYQQKPGKAPKLLIYAASSLKSGVPSRFSGSGSGTDFTLTISSLQPEDFATYYCQQANSFPLTFGGGTKVEIK

SEQ ID NO: 765 - protein, 108 aa, Artificial Sequence [sequence omitted]

SEQ ID NO: 766 - protein, 113 aa, Artificial Sequence [sequence omitted]

SEQ ID NO: 767 - protein, 107 aa, Artificial Sequence
  Description of Artificial Sequence: Synthetic polypeptide
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIK

SEQ ID NO: 768 - protein, 108 aa, Artificial Sequence
  Description of Artificial Sequence: Synthetic polypeptide
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIK

SEQ ID NO: 769 - protein, 107 aa, Artificial Sequence
  Description of Artificial Sequence: Synthetic polypeptide
EIVLTQSPDFQSVTPKEKVTITCRASQSIGISLHWYQQKPDQSPKLLIKYASQSFSGVPSRFSGSGSGTDFTLTINSLEAEDAATYYCHQSRSFPWTFGQGTKVEIK

SEQ ID NO: 770 - protein, 113 aa, Artificial Sequence
  Description of Artificial Sequence: Synthetic polypeptide
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK

SEQ ID NO: 771 - protein, 107 aa, Artificial Sequence
  Description of Artificial Sequence: Synthetic polypeptide
ELQMTQSPSSLSASVGDRVTITCRTSQSISSYLNWYQQKPGQPPKLLIYWASTRESGVPDRFSGSGSGTDFTLTISSLQPEDSATYYCQQSYDIPYTFGQGTKLEIK

SEQ ID NO: 772 - protein, 107 aa, Artificial Sequence
  Description of Artificial Sequence: Synthetic polypeptide
NIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIK

SEQ ID NO: 773 - protein, 106 aa, Artificial Sequence
  Description of Artificial Sequence: Synthetic polypeptide
QILLTQSPAIMSASPGEKVTMTCSASSSVSYMLWYQQKPGSSPKPWIFDTSNLASGFPARFSGSGSGTSYSLIISSMEAEDAATYYCHQRSGYPYTFGGGTKLEIK

SEQ ID NO: 774 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSYPLTFGGGTKVKES

SEQ ID NO: 775 - protein, 112 aa, Artificial Sequence
  Description of Artificial Sequence: Synthetic polypeptide
DIVMTQSPLSLPVTPGEPASISCRSSINKKGSNGITYLYWYLQKPGQSPQLLIYQMSNLASGVPDRFSGSGSGTDFTLKISRVEAEDVGVYYCAQNLEIPRTFGQGTKVEIK

SEQ ID NO: 776 - protein, 112 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIK

SEQ ID NO: 777 - protein, 112 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELK

SEQ ID NO: 778 - protein, 107 aa, Artificial Sequence
  Description of Artificial Sequence: Synthetic polypeptide
DIQMTQSPSSLSASVGDRVTITCRASQSISTWLAWYQQKPGKAPKLLIYKASNLHTGVPSRFSGSGSGTEFSLTISGLQPDDFATYYCQQYNSYSRTFGQGTKVEIK

SEQ ID NO: 779 - protein, 110 aa, Artificial Sequence
  Description of Artificial Sequence: Synthetic polypeptide
DIQLTQSPSSLSASVGDRVTITCSVSSSISSNNLHWYQQKPGKAPKPWIYGTSNLASGVPSRFSGSGSGTDYTFTISSLQPEDIATYYCQQWSSYPYMYTFGQGTKVEIK

SEQ ID NO: 780 - protein, 111 aa, Artificial Sequence
  Description of Artificial Sequence: Synthetic polypeptide
DIVLTQSPLSLAVSLGQPAIISCKASQSVSFAGTSLMHWYHQKPGQQPRLLIYRASNLEAGVPDRFSGSGSKTDFTLNISPVEAEDAATYYCQQSREYPYTFGGGTKLEIK

SEQ ID NO: 781 - protein, 111 aa, Artificial Sequence
  Description of Artificial Sequence: Synthetic polypeptide
DIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIK

SEQ ID NO: 782 - protein, 100 aa, Artificial Sequence
  Description of Artificial Sequence: Synthetic polypeptide
PASLSASVGETVTITCRTSENIFSYLAWYQQKQGISPQLLVYNAKTLAEGVPSRFSGSGSGTQFSLKINSLQPEDFGSYYCQHHYAFPWTFGGGSKLEIK

SEQ ID NO: 783 - protein, 112 aa, Artificial Sequence
  Description of Artificial Sequence: Synthetic polypeptide
DVVMTQSPLSLPVTPGEPASISCRSSQSLVHSNGNTYLHWYLQKPGQSPQLLIYKVSNRFSGVPDRFSGSGSGTDFTLKISRVEAEDVGVYYCSQNTHVPPTFGQGTKLEIK

SEQ ID NO: 784 - protein, 107 aa, Artificial Sequence
  Description of Artificial Sequence: Synthetic polypeptide
EIVLTQSPGTLSLSPGERATLSCRAVQSVSSSYLAWYQQKPGQAPRLLIYGASSRATGIPDRFSGSGSGTDFTLTISRLEPEDFAVYYCQQYGSSPTFGGGTKVEIK

SEQ ID NO: 785 - protein, 107 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGGGTKVEIK

SEQ ID NO: 786 - protein, 107 aa, Artificial Sequence
  Description of Artificial Sequence: Synthetic polypeptide
EILLTQSPGTLSLSPGERATLSCRASQSVSSSYLAWYQQKPGQAPRLLIYGASSRATGIPDRFSGSGSGTDFTLTISRLEPEDFAVYYCQQYGSSPTFGQGTKVEIK

SEQ ID NO: 787 - protein, 112 aa, Artificial Sequence
  Description of Artificial Sequence: Synthetic polypeptide
DTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIK

SEQ ID NO: 788 - protein, 107 aa, Artificial Sequence
  Description of Artificial Sequence: Synthetic polypeptide
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELK

SEQ ID NO: 789 - protein, 106 aa, Artificial Sequence [sequence omitted]

SEQ ID NO: 790 - protein, 107 aa, Artificial Sequence [sequence omitted]

SEQ ID NO: 791 - protein, 107 aa, Artificial Sequence [sequence omitted]

SEQ ID NO: 792 - protein, 107 aa, Artificial Sequence
  Description of Artificial Sequence: Synthetic polypeptide
DIQMTQSPSTLSASVGDRVTITCRASQSISSWWAWYQQKPGKAPKLLIYDASSLESGVPSRFSGSGSGTEFTLTISSLQPDDFATYYCQQYHAHPTTFGGGTKVEIK

SEQ ID NO: 793 - protein, 113 aa, Artificial Sequence
  Description of Artificial Sequence: Synthetic polypeptide
DIVMTQSPDSLAVSLGERATINCKSSQSVLYSPNNKNYLAWYQQKPGQPPKLLIYWASTRESGVPDRFSGSGSGTDFTLTISSLQAEDVAVYYCQQYYGSPITFGGGTKVEIK

SEQ ID NO: 794 - protein, 108 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQDYRTWPRRVFGGGTKVEIK

SEQ ID NO: 795 - protein, 112 aa, Artificial Sequence [sequence omitted]

SEQ ID NO: 796 - protein, 107 aa, Artificial Sequence [sequence omitted]

SEQ ID NO: 797 - protein, 112 aa, Artificial Sequence
  Description of Artificial Sequence: Synthetic polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIK

SEQ ID NO: 798 - protein, 111 aa, Artificial Sequence
  Description of Artificial Sequence: Synthetic polypeptide
DVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVLTFGSGTKLEIK

SEQ ID NO: 799 - protein, 102 aa, Artificial Sequence
  Description of Artificial Sequence: Synthetic polypeptide
QSPSFLSAFVGDRITITCRASPGIRNYLAWYQQKPGKAPKLLIYAASTLQSGVPSRFSGSGSGTDFTLTISSLQPEDFATYYCQQYNSYPLSFGGGTKVEIK

SEQ ID NO: 800 - protein, 110 aa, Artificial Sequence
  Description of Artificial Sequence: Synthetic polypeptide
QAVVTQEPSFSVSPGGTVTLTCGLSSGSVSTSYYPSWYQQTPGQAPRTLIYSTNTRSSGVPDRFSGSILGNKAALTITGAQADDESDYYCVLYMGSGQYVFGGGTKLTVL

SEQ ID NO: 801 - protein, 107 aa, Artificial Sequence [sequence omitted]

SEQ ID NO: 802 - protein, 107 aa, Artificial Sequence
  Description of Artificial Sequence: Synthetic polypeptide
DIVMTQSHKFMSTSVGDRVSITCKASQDVNTAVAWYQQKPGHSPKLLIYSASFRYTGVPDRFTGSRSGTDFTFTISSVQAEDLAVYYCQQHYTTPPTFGGGTKVEIK

SEQ ID NO: 803 - protein, 111 aa, Artificial Sequence
  Description of Artificial Sequence: Synthetic polypeptide
QSVLTQPPSVSGAPGQRVTISCTGSSSNIGAGYGVHWYQQLPGTAPKLLIYGNTNRPSGVPDRFSGFKSGTSASLAITGLQAEDEADYYCQFYDSSLSGWVFGGGTKLTVL

SEQ ID NO: 804 - protein, 107 aa, Artificial Sequence [sequence omitted]

SEQ ID NO: 805 - protein, 111 aa, Artificial Sequence [sequence omitted]

SEQ ID NO: 806 - protein, 107 aa, Artificial Sequence [sequence omitted]

SEQ ID NO: 807 - protein, 111 aa, Artificial Sequence
  Description of Artificial Sequence: Synthetic polypeptide
QSALTQPASVSGSPGQSITISCTGTSSDVGGYNFVSWYQQHPGKAPKLMIYDVSDRPSGVSDRFSGSKSGNTASLIISGLQADDEADYYCSSYGSSSTHVIFGGGTKVTVL

SEQ ID NO: 808 - protein, 110 aa, Artificial Sequence
  Description of Artificial Sequence: Synthetic polypeptide
QSVLTQPPSVSAAPGQKVTISCSGSSSNIGNNYVSWYQQLPGTAPKLLIYDHTNRPAGVPDRFSGSKSGTSASLAISGFRSEDEADYYCASWDYTLSGWVFGGGTKLTVL

SEQ ID NO: 809 - protein, 112 aa, Artificial Sequence
  Description of Artificial Sequence: Synthetic polypeptide
DIQMTQSPSSLSASVGDRVTITCRSSQRIVHSNGNTYLEWYQQTPGKAPKLLIYKVSNRFSGVPSRFSGSGSGTDFTFTISSLQPEDIATYYCFQGSHVPFTFGQGTKLQIT

SEQ ID NO: 810 - protein, 111 aa, Artificial Sequence
  Description of Artificial Sequence: Synthetic polypeptide
DIALTQPASVSGSPGQSITISCTGTSSDIGGYNSVSWYQQHPGKAPKLMIYGVNNRPSGVSNRFSGSKSGNTASLTISGLQAEDEADYYCSSYDIESATPVFGGGTKLTVL

SEQ ID NO: 811 - protein, 106 aa, Artificial Sequence
  Description of Artificial Sequence: Synthetic polypeptide
DIELTQSPAIMSASPGEKVTMTCSASSSVSYMHWYQQKSGTSPKRWIYDTSKLASGVPGRFSGSGSGNSYSLTISSVEAEDDATYYCQQWSGYPLTFGAGTKLEIK

SEQ ID NO: 812 - protein, 107 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIK

SEQ ID NO: 813 - protein, 107 aa, Artificial Sequence; identical to SEQ ID NO: 812
  Description of Artificial Sequence: Synthetic polypeptide

SEQ ID NO: 814 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSQYTFGQGTKLEIK

SEQ ID NO: 815 - protein, 106 aa, Artificial Sequence
  Description of Artificial Sequence: Synthetic polypeptide
DIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGSGTKVEIK

SEQ ID NO: 816 - protein, 108 aa, Artificial Sequence
  Description of Artificial Sequence: Synthetic polypeptide
DIVMTQSPAIMSASPGEKVTMTCSASSSVSSSYLYWYQQKPGSSPKLWIYSTSNLASGVPARFSGSGSGTSYSLTISSMEAEDAASYFCHQWNRYPYTFGGGTKLEIK

SEQ ID NO: 817 - protein, 108 aa, Artificial Sequence
  Description of Artificial Sequence: Synthetic polypeptide
DIQLTQSPSSLSASVGDRVTMTCSASSSVSSSYLYWYQQKPGKAPKLWIYSTSNLASGVPARFSGSGSGTDFTLTISSLQPEDSASYFCHQWNRYPYTFGGGTRLEIK

SEQ ID NO: 818 - protein, 106 aa, Artificial Sequence
  Description of Artificial Sequence: Synthetic polypeptide
EIVLTQSPATMSASPGERVTITCSAHSSVSFMHWFQQKPGTSPKLWIYSTSSLASGVPARFGGSGSGTSYSLTISSMEAEDAATYYCQQRSSFPLTFGAGTKLELK

SEQ ID NO: 819 - protein, 113 aa, Artificial Sequence
  Description of Artificial Sequence: Synthetic polypeptide
DIVMSQSPSSLAVSVGEKVTMSCKSSQSLLYSSNQKIYLAWYQQKPGQSPKLLIYWASTRESGVPDRFTGGGSGTDFTLTISSVKAEDLAVYYCQQYYRYPRTFGGGTKLEIK

SEQ ID NO: 820 - protein, 113 aa, Artificial Sequence
  Description of Artificial Sequence: Synthetic polypeptide
DIQMTQSPSSLSASVGDRVTITCKSSQSLLYSSNQKIYLAWYQQKPGKAPKLLIYWASTRESGVPSRFSGSGSGTDFTFTISSLQPEDIATYYCQQYYRYPRTFGQGTKVEIK

SEQ ID NO: 821 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 822 - protein, 108 aa, Artificial Sequence
  Description of Artificial Sequence: Synthetic polypeptide
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 823 - protein, 107 aa, Artificial Sequence [sequence omitted]

SEQ ID NO: 824 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 825 - protein, 107 aa, Artificial Sequence
  Description of Artificial Sequence: Synthetic polypeptide
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIK

SEQ ID NO: 826 - protein, 107 aa, Artificial Sequence
  Description of Artificial Sequence: Synthetic polypeptide
DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 827 - protein, 112 aa, Artificial Sequence
  Description of Artificial Sequence: Synthetic polypeptide
ELVLTQSPSVSAALGSPAKITCTLSSAHKTDTIDWYQQLQGEAPRYLMQVQSDGSYTKRPGVPDRFSGSSSGADRYLIIPSVQADDEADYYCGADYIGGYVFGGGTQLTVTG

SEQ ID NO: 828 - protein, 107 aa, Artificial Sequence
  Description of Artificial Sequence: Synthetic polypeptide
DIKMTQSPSSMYASLGERVTITCKASPDINSYLSWFQQKPGKSPKTLIYRANRLVDGVPSRFSGGGSGQDYSLTINSLEYEDMGIYYCLQYDEFPYTFGGGTKLEMK

SEQ ID NO: 829 - protein, 108 aa, Artificial Sequence
  Description of Artificial Sequence: Synthetic polypeptide
ELVMTQTPSSVSAAVGGTVTINCQASQSIGSYLAWYQQKPGQPPKLLIYYASNLASGVPSRFSGSGSGTEYTLTISGVQREDAATYYCLGSLSNSDNVFGGGTELEIL

SEQ ID NO: 830 - protein, 110 aa, Artificial Sequence
  Description of Artificial Sequence: Synthetic polypeptide
ELVMTQTPSSTSGAVGGTVTINCQASQSIDSNLAWFQQKPGQPPTLLIYRASNLASGVPSRFSGSRSGTEYTLTISGVQREDAATYYCLGGVGNVSYRTSFGGGTEVVVK

SEQ ID NO: 831 - protein, 113 aa, Artificial Sequence
  Description of Artificial Sequence: Synthetic polypeptide
DIVMSQSPDSLAVSLGERVTLNCKSSQSLLYSGNQKNYLAWYQQKPGQSPKLLIYWASARESGVPDRFSGSGSGTDFTLTISSVQAEDVAVYYCQQYYSYPLTFGAGTKLELK

SEQ ID NO: 832 - protein, 107 aa, Artificial Sequence
  Description of Artificial Sequence: Synthetic polypeptide
SIVMTQTPKFLLVSAGDRVTITCKASQSVSNDVAWYQQKPGQSPKLLINFATNRYTGVPNRFTGSGYGTDFTFTISTVQAEDLALYFCQQDYSSPWTFGGGTKLEIK

SEQ ID NO: 833 - protein, 115 aa, Artificial Sequence
  Description of Artificial Sequence: Synthetic polypeptide
SVIMSRGQIVLTQSPAIMSASLGERVTLTCTASSSVNSNYLHWYQQKPGSSPKLWIYSTSNLASGVPARFSGSGSGTSYSLTISSMEAEDAATYYCHQYHRSPLTFGAGTKLELK

SEQ ID NO: 834 - protein, 107 aa, Artificial Sequence
  Description of Artificial Sequence: Synthetic polypeptide
DIVMTQSHIFMSTSVGDRVSITCKASQDVDTAVAWYQQKPGQSPKLLIYWASTRLTGVPDRFTGSGSGTDFTLTISNVQSEDLADYFCQQYSSYPYTFGGGTKLEIK

SEQ ID NO: 835 - protein, 107 aa, Artificial Sequence
  Description of Artificial Sequence: Synthetic polypeptide
DIQLTQSPSSLSASVGDRVSITCKASQDVSIAVAWYQQKPGKAPKLLIYSASYRYTGVPDRFSGSGSGTDFTLTISSLQPEDFAVYYCQQHYITPLTFGAGTKVEIK

SEQ ID NO: 836 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 837 - protein, 107 aa, Artificial Sequence [sequence omitted]

SEQ ID NO: 838 - protein, 107 aa, Artificial Sequence
  Description of Artificial Sequence: Synthetic polypeptide
DIQMTQSPSSLSASVGDRVTITCRASQDIAGSLNWLQQKPGKAIKRLIYATSSLDSGVPKRFSGSRSGSDYTLTISSLQPEDFATYYCLQYGSFPPTFGQGTKVEIK

SEQ ID NO: 839 - protein, 111 aa, Artificial Sequence
  Description of Artificial Sequence: Synthetic polypeptide
DIVLTQSPASLAVSLGQRATISCRASESVDSYGNSFMHWYQQKPGQPPKLLIYRASNLESGIPARFSGSGSRTDFTLTINPVEADDVATYYCQQSNEDPLTFGAGTKLELK

SEQ ID NO: 840 - protein, 15 aa, Artificial Sequence
  Description of Artificial Sequence: Synthetic peptide
GGGGSGGGGSGGGGS

SEQ ID NO: 841 - protein, 18 aa, Artificial Sequence
  Description of Artificial Sequence: Synthetic peptide
GEGTSTGSGGSGGSGGAD

SEQ ID NO: 842 - protein, 18 aa, Artificial Sequence
  Description of Artificial Sequence: Synthetic peptide
VEGGSGGSGGSGGSGGVD

SEQ ID NO: 843 - protein, 29 aa, Artificial Sequence
  Description of Artificial Sequence: Synthetic peptide
RTSGPGDGGKGGPGKGPGGEGTKGTGPGG

SEQ ID NO: 844 - protein, 30 aa, Artificial Sequence
  Description of Artificial Sequence: Synthetic polypeptide
GSGEGSEGEGGGEGSEGEGSGEGGEGEGSG

SEQ ID NO: 845 - protein, 32 aa, Artificial Sequence
  Description of Artificial Sequence: Synthetic polypeptide
TGSGEGSEGEGGGEGSEGEGSGEGGEGEGSGT

SEQ ID NO: 846 - protein, 30 aa, Artificial Sequence
  Description of Artificial Sequence: Synthetic polypeptide
GATPPETGAETESPGETTGGSAESEPPGEG

SEQ ID NO: 847 - protein, 30 aa, Artificial Sequence
  Description of Artificial Sequence: Synthetic polypeptide
GSAAPTAGTTPSASPAPPTGGSSAAGSPST

SEQ ID NO: 848 - protein, 30 aa, Artificial Sequence
  Description of Artificial Sequence: Synthetic polypeptide
GEGGESGGSEGEGSGEGEGGSGGEGESEGG

SEQ ID NO: 849 - protein, 30 aa, Artificial Sequence
  Description of Artificial Sequence: Synthetic polypeptide
STETSPSTPTESPEAGSGSGSPESPSGTEA

SEQ ID NO: 850 - protein, 30 aa, Artificial Sequence
  Description of Artificial Sequence: Synthetic polypeptide
PTGTTGEPSGEGSEPEGSAPTSSTSEATPS

SEQ ID NO: 851 - protein, 30 aa, Artificial Sequence
  Description of Artificial Sequence: Synthetic polypeptide
SESESEGEAPTGPGASTTPEPSESPTPETS

SEQ ID NO: 852 - protein, 30 aa, Artificial Sequence
  Description of Artificial Sequence: Synthetic polypeptide
PEGGESGEGTGPGTGGEPEGEGGPGGEGGT

SEQ ID NO: 853 - protein, 6 aa, Artificial Sequence
  Description of Artificial Sequence: Synthetic peptide
SGGGGS

SEQ ID NO: 854 - protein, 5 aa, Artificial Sequence
  Description of Artificial Sequence: Synthetic peptide
GGGGS

SEQ ID NO: 855 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 856 - protein, 144 aa, Artificial Sequence
  Description of Artificial Sequence: Synthetic polypeptide
SPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPG

SEQ ID NO: 857 - protein, 144 aa, Artificial Sequence
  Description of Artificial Sequence: Synthetic polypeptide
TSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 858 - protein, 144 aa, Artificial Sequence; identical to SEQ ID NO: 857
  Description of Artificial Sequence: Synthetic polypeptide

SEQ ID NO: 859 - protein, 144 aa, Artificial Sequence
  Description of Artificial Sequence: Synthetic polypeptide
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 860 - protein, 144 aa, Artificial Sequence; identical to SEQ ID NO: 859
  Description of Artificial Sequence: Synthetic polypeptide

SEQ ID NO: 861 - protein, 144 aa, Artificial Sequence
  Description of Artificial Sequence: Synthetic polypeptide
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 862 - protein, 144 aa, Artificial Sequence; identical to SEQ ID NO: 861
  Description of Artificial Sequence: Synthetic polypeptide

SEQ ID NO: 863 - protein, 144 aa, Artificial Sequence
  Description of Artificial Sequence: Synthetic polypeptide
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 864 - protein, 144 aa, Artificial Sequence
  Description of Artificial Sequence: Synthetic polypeptide
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 865 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 866 - protein, 288 aa, Artificial Sequence
  Description of Artificial Sequence: Synthetic polypeptide
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 867 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 868 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 869 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 870 - protein, 865 aa, Artificial Sequence
  Description of Artificial Sequence: Synthetic polypeptide
GGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 871 - protein, 866 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 872 - protein, 1152 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 873 - protein, 144 aa, Artificial Sequence
  Description of Artificial Sequence: Synthetic polypeptide
STEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGS

SEQ ID NO: 874 - protein, 144 aa, Artificial Sequence
  Description of Artificial Sequence: Synthetic polypeptide
SEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPG

SEQ ID NO: 875 - protein, 180 aa, Artificial Sequence
  Description of Artificial Sequence: Synthetic polypeptide
TSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 876 - protein, 216 aa, Artificial Sequence
  Description of Artificial Sequence: Synthetic polypeptide
PESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 877 - protein, 252 aa, Artificial Sequence
  Description of Artificial Sequence: Synthetic polypeptide
ESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 878 - protein, 288 aa, Artificial Sequence
  Description of Artificial Sequence: Synthetic polypeptide
TPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 879 - protein, 324 aa, Artificial Sequence
  Description of Artificial Sequence: Synthetic polypeptide
PESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 880 - protein, 360 aa, Artificial Sequence
  Description of Artificial Sequence: Synthetic polypeptide
PESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 881 - protein, 360 aa, Artificial Sequence
  Description of Artificial Sequence: Synthetic polypeptide
PESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPS

SEQ ID NO: 882 - protein, 432 aa, Artificial Sequence
  Description of Artificial Sequence: Synthetic polypeptide
EGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 883 - protein, 468 aa, Artificial Sequence
  Description of Artificial Sequence: Synthetic polypeptide
EGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 884 - protein, 504 aa, Artificial Sequence
  Description of Artificial Sequence: Synthetic polypeptide
EGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 885 - protein, 540 aa, Artificial Sequence
  Description of Artificial Sequence: Synthetic polypeptide
TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP

SEQ ID NO: 886 - protein, 576 aa, Artificial Sequence
  Description of Artificial Sequence: Synthetic polypeptide
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 887 - protein, 612 aa, Artificial Sequence
  Description of Artificial Sequence: Synthetic polypeptide
GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 888 - protein, 648 aa, Artificial Sequence
  Description of Artificial Sequence: Synthetic polypeptide
PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 889 - protein, 684 aa, Artificial Sequence
  Description of Artificial Sequence: Synthetic polypeptide
EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 890 - protein, 720 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE

SEQ ID NO: 891 - protein, 756 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSES

SEQ ID NO: 892 - protein, 792 aa, Artificial Sequence
  Description of Artificial Sequence: Synthetic polypeptide
EGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 893 - protein, 828 aa, Artificial Sequence
  Description of Artificial Sequence: Synthetic polypeptide
PESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 894 - protein, 869 aa, Artificial Sequence
  Description of Artificial Sequence: Synthetic polypeptide
GSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGR

SEQ ID NO: 895 - protein, 144 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASR

SEQ ID NO: 896 - protein, 288 aa, Artificial Sequence
  Description of Artificial Sequence: Synthetic polypeptide
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 897 - protein, 432 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTESASR

SEQ ID NO: 898 - protein, 576 aa, Artificial Sequence
  Description of Artificial Sequence: Synthetic polypeptide
SAGSPTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 899 - protein, 864 aa, Artificial Sequence
  Description of Artificial Sequence: Synthetic polypeptide
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 900 - protein, 712 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEAHHH

SEQ ID NO: 901 - protein, 864 aa, Artificial Sequence
  Description of Artificial Sequence: Synthetic polypeptide
GSPGAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 902 - protein, 12 aa, Artificial Sequence
  Description of Artificial Sequence: Synthetic peptide
GESPGGSSGSES

SEQ ID NO: 903 - protein, 12 aa, Artificial Sequence
  Description of Artificial Sequence: Synthetic peptide
GSEGSSGPGESS

SEQ ID NO: 904 - protein, 12 aa, Artificial Sequence
  Description of Artificial Sequence: Synthetic peptide
GSSESGSSEGGP

SEQ ID NO: 905 - protein, 12 aa, Artificial Sequence
  Description of Artificial Sequence: Synthetic peptide
GSGGEPSESGSS

SEQ ID NO: 906 - protein, 12 aa, Artificial Sequence
  Description of Artificial Sequence: Synthetic peptide
GSPAGSPTSTEE

SEQ ID NO: 907 - protein, 12 aa, Artificial Sequence
  Description of Artificial Sequence: Synthetic peptide
GSEPATSGSETP

SEQ ID NO: 908 - protein, 12 aa, Artificial Sequence
  Description of Artificial Sequence: Synthetic peptide
GTSESATPESGP

SEQ ID NO: 909 - protein, 12 aa, Artificial Sequence
  Description of Artificial Sequence: Synthetic peptide
GTSTEPSEGSAP

SEQ ID NO: 910 - protein, 12 aa, Artificial Sequence
  Description of Artificial Sequence: Synthetic peptide
GSTSESPSGTAP

SEQ ID NO: 911 - protein, 12 aa, Artificial Sequence
  Description of Artificial Sequence: Synthetic peptide
GTSTPESGSASP

SEQ ID NO: 912 - protein, 12 aa, Artificial Sequence
  Description of Artificial Sequence: Synthetic peptide
GTSPSGESSTAP

SEQ ID NO: 913 - protein, 12 aa, Artificial Sequence
  Description of Artificial Sequence: Synthetic peptide
GSTSSTAESPGP

SEQ ID NO: 914 - protein, 12 aa, Artificial Sequence
  Description of Artificial Sequence: Synthetic peptide
GTPGSGTASSSP

SEQ ID NO: 915 - protein, 12 aa, Artificial Sequence
  Description of Artificial Sequence: Synthetic peptide
GSSTPSGATGSP

SEQ ID NO: 916 - protein, 12 aa, Artificial Sequence
  Description of Artificial Sequence: Synthetic peptide
GSSPSASTGTGP

SEQ ID NO: 917 - protein, 12 aa, Artificial Sequence
  Description of Artificial Sequence: Synthetic peptide
GASPGTSSTGSP

SEQ ID NO: 918 - protein, 6 aa, Artificial Sequence
  Description of Artificial Sequence: Synthetic 6xHis tag
HHHHHH

SEQ ID NO: 919 - protein, 8 aa, Artificial Sequence
  Description of Artificial Sequence: Synthetic 8xHis tag
HHHHHHHH

SEQ ID NO: 920 - protein, 288 aa, Artificial Sequence
  Description of Artificial Sequence: Synthetic polypeptide
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPG

SEQ ID NO: 921 - protein, 284 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 922 - protein, 292 aa, Artificial Sequence
  Description of Artificial Sequence: Synthetic polypeptide
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 923 - protein, 864 aa, Artificial Sequence
  Description of Artificial Sequence: Synthetic polypeptide
AGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 924 - protein, 867 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 925 - protein, 867 aa, Artificial Sequence
  Description of Artificial Sequence: Synthetic polypeptide
SPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 926 - protein, 868 aa, Artificial Sequence
  Description of Artificial Sequence: Synthetic polypeptide
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 927 - protein, 16 aa, Artificial Sequence
  Description of Artificial Sequence: Synthetic peptide
LSGRSDNHSPLGLAGS

SEQ ID NO: 928 - DNA, 4257 bp, Artificial Sequence
  Description of Artificial Sequence: Synthetic polynucleotide
atgaagaaaaacatcgcttttcttcttgcatctatgttcgttttttctattgctacaaacgcgtacgctcatcaccaccatcatcaccatcacgaactggttatgacccaaagcccgagcagcctgaccgttaccgcgggcgaaaaggttaccatgagctgcaaaagcagccaaagcctgctgaacagcggcaaccaaaagaactacctgacctggtaccaacagaagccgggtcagccgccgaaactgctgatctactgggcgagcacccgtgagagcggcgttccggaccgttttaccggcagcggcagcggtaccgactttaccctgaccattagcagcgtgcaggcggaagatctggcggtgtactattgccaaaacgactacagctacccgctgacctttggtgcgggcaccaaactggagatcaagggtggcggtggcagcggcggtggtggcagcggcggcggtggcagcgaggttcagctgctggaacagagcggcgcggagctggtgcgtccgggtaccagcgttaagatcagctgcaaggcgagcggttatgcgttcaccaactactggctgggttgggtgaagcaacgtccgggtcacggtctggagtggatcggcgacattttcccgggcagcggtaacatccactacaacgagaaattcaagggtaaagcgaccctgaccgcggataaaagcagcagcaccgcgtatatgcagctgagcagcctgaccttcgaagatagcgcggtttacttctgcgcgcgtctgcgtaactgggatgaaccgatggattactggggtcagggcaccaccgtgaccgttagcagcggtggtggcggcagcgatgttcagctggtgcaaagcggtgcggaagtgaaaaagccgggtgcgagcgtgaaagttagctgcaaagcgagcggctataccttcacccgttacaccatgcactgggttcgtcaggcgccgggtcagggcctggaatggatcggctacatcaacccgagccgtggctataccaactacgcggatagcgtgaaaggtcgtttcaccattaccaccgacaaaagcaccagcaccgcgtacatggaactgagcagcctgcgtagcgaggataccgcgacctactattgcgcgcgttactatgatgaccactactgcctggactattggggccaaggtaccaccgttaccgtgagcagcggtgaaggcaccagcaccggcagcggtggtagcggtggtagcggcggtgcggatgacatcgttctgacccaaagcccggcgaccctgagcctgagcccgggcgagcgtgcgaccctgagctgccgtgcgagccagagcgttagctacatgaactggtaccagcaaaagccgggcaaagcgccgaagcgttggatttatgataccagcaaggttgcgagcggtgttccggcgcgtttcagcggtagcggtagcggcaccgattatagcctgaccattaacagcctggaggcggaagatgcggcgacctactactgccaacaatggagcagcaatccgctgaccttcggtggtggtaccaaagttgaaattaagggcaccgccgaagcagctagcgcctctggcctgtcaggtcgttctgataaccattccccactgggtctggctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggt

SEQ ID NO: 929 - DNA, 4329 bp, Artificial Sequence
  Description of Artificial Sequence: Synthetic polynucleotide
atgaagaaaaacatcgcttttcttcttgcatctatgttcgttttttctattgctacaaacgcgtacgctgatattcagatgacccaatcgccgtcgtccctgtcagcttcagtcggtgatcgtgttaccattacctgtcgctcaacgaaatccctgctgcattcaaacggtattacctatctgtactggtatcagcaaaaaccgggcaaagcgccgaaactgctgatctaccagatgtcgaatctggccagcggtgttccgtctcgttttagctctagtggttctggcaccgatttcaccctgacgatttcctcactgcaaccggaagactttgcaacgtattactgcgctcagaacctggaaatcccgcgtaccttcggtcaaggcacgaaagtcgaaattaaaggtgcaacgcctccggagactggtgctgaaactgagtccccgggcgagacgaccggtggctctgctgaatccgaaccaccgggcgaaggccaagtgcaactggttcagagcggtccgggtctggtccaaccgggtggcagtgtgcgtatttcctgcgcggcctcaggttacacctttacgaactatggcatgaattgggtgaaacaggccccgggtaaaggcctggaatggatgggttggatcaacacctacacgggcgaatctacctatgcagatagtttcaaaggccgctttaccttcagcctggacacgtctgctagtgcagcttatctgcagattaatagcctgcgtgcggaagatacggccgtttattactgtgcgcgctttgcaatcaaaggcgactactggggccaaggcaccctgctgaccgtgtcctccggtggtggcggcagcgacatccaaatgacccagagcccgagcagcctgagcgcgagcgtgggcgaccgtgttaccatcacctgccgtgcgagccaagacatccgtaactacctgaactggtatcagcaaaagccgggtaaagcgccgaagctgctgatctactataccagccgtctggagagcggcgtgccgagccgtttcagcggtagcggtagcggtaccgactacaccctgaccattagcagcctgcagccggaagatttcgcgacctactattgccagcagggtaacaccctgccgtggacctttggtcaaggcaccaaagttgagattaaaggcgccacgcctccggaaactggtgctgagacggaatcccctggtgaaaccactggcggttctgccgaatctgaaccgcctggtgaaggcgaggtgcagctggttgaaagcggtggcggtctggtgcaaccaggcggtagcctgcgtctgagctgcgcggcgagcggttacagctttaccggttataccatgaactgggttcgtcaagcgccaggtaaaggtctggagtgggtggcgctgatcaacccgtacaagggtgttagcacctataaccagaagttcaaagaccgttttaccattagcgtggataagagcaaaaacaccgcgtacctgcaaatgaacagcctgcgtgcggaggacaccgctgtgtactattgcgcgcgtagcggttactatggcgacagcgactggtattttgatgtgtggggccaaggcaccctggttaccgtgagctccggcaccgccgaagcagctagcgcctctggcctgtcaggtcgttctgataaccattccccactgggtctggctgggtctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 930 - protein, 1419 aa, Artificial Sequence
  Description of Artificial Sequence: Synthetic polypeptide
MKKNIAFLLASMFVFSIATNAYAHHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 931 - protein, 1443 aa, Artificial Sequence
  Description of Artificial Sequence: Synthetic polypeptide
MKKNIAFLLASMFVFSIATNAYADIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 932 - protein, 23 aa, Artificial Sequence
  Description of Artificial Sequence: Synthetic peptide
MKKNIAFLLASMFVFSIATNAYA

SEQ ID NO: 933 - protein, 1398 aa, Artificial Sequence
  Description of Artificial Sequence: Synthetic polypeptide
HHHHHHHHDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 934 - protein, 1396 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 935 - protein, 1386 aa, Artificial Sequence
  Description of Artificial Sequence: Synthetic polypeptide
HHHHHHHHEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 936 - protein, 1380 aa, Artificial Sequence
  Description of Artificial Sequence: Synthetic polypeptide
HHHHHHHHDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 937 - protein, 1372 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 938 - protein, 1411 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKRTSGPGDGGKGGPGKGPGGEGTKGTGPGGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 939 - protein, 1411 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSRTSGPGDGGKGGPGKGPGGEGTKGTGPGGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 940 - protein, 1423 aa, Artificial Sequence
  Description of Artificial Sequence: Synthetic polypeptide
HHHHHHHHGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGLSGRSDNHSPLGLAGSGTAEAASASGELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 941 - protein, 1398 aa, Artificial Sequence
  Description of Artificial Sequence: Synthetic polypeptide
GSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGLSGRSDNHSPLGLAGSGTAEAASASGELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHHHH

SEQ ID NO: 942 - protein, 1396 aa, Artificial Sequence
  Description of Artificial Sequence: Synthetic polypeptide
HHHHHHHHELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 943 - protein, 1396 aa, Artificial Sequence
  Description of Artificial Sequence: Synthetic polypeptide
HHHHHHHHEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSGGGGSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 944 - protein, 1396 aa, Artificial Sequence
  Description of Artificial Sequence: Synthetic polypeptide
HHHHHHHHDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 945 - protein, 1396 aa, Artificial Sequence
  Description of Artificial Sequence: Synthetic polypeptide
HHHHHHHHDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKGEGTSTGSGGSGGSGGADDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGGGGSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 946 - protein, 1420 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 947 - protein, 1396 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 948 - protein, 1425 aa, Artificial Sequence
  Description of Artificial Sequence: Synthetic polypeptide
DIVMTQSPLSLPVTPGEPASISCRSSKNLLHSNGITYLYWYLQKPGQSPQLLIYQMSNLASGVPDRFSSSGSGTDFTLKISRVEAEDVGVYYCAQNLEIPRTFGQGTKVEIKGATPPETGAETESPGETTGGSAESEPPGEGQVQLVQSGPEVKKPGASVKVSCKASGYTFTNYGMNWVRQAPGQGLEWMGWINTYTGEPTYGEDFKGRFAFSLDTSASTAYMELSSLRSEDTAVYFCARFGNYVDYWGQGSLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 949 - protein, 1401 aa, Artificial Sequence
  Description of Artificial Sequence: Synthetic polypeptide
DIVMTQSPLSLPVTPGEPASISCRSSKNLLHSNGITYLYWYLQKPGQSPQLLIYQMSNLASGVPDRFSSSGSGTDFTLKISRVEAEDVGVYYCAQNLEIPRTFGQGTKVEIKGATPPETGAETESPGETTGGSAESEPPGEGQVQLVQSGPEVKKPGASVKVSCKASGYTFTNYGMNWVRQAPGQGLEWMGWINTYTGEPTYGEDFKGRFAFSLDTSASTAYMELSSLRSEDTAVYFCARFGNYVDYWGQGSLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 950 - protein, 1419 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPLSGRSDNHSPLGLAGSGTAEAASASGDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGGGGSDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 951 - protein, 1396 aa, Artificial Sequence
  Description of Artificial Sequence: Synthetic polypeptide
HHHHHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGGGGSDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSS

SEQ ID NO: 952 - protein, 1419 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 953 - protein, 1395 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 954 - protein, 1424 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 955 - protein, 1400 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 956 - protein, 1418 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 957 - protein, 1394 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 958 - protein, 1423 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 959 - protein, 1399 aa, Artificial Sequence
  Description of Artificial Sequence: Synthetic polypeptide
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKGATPPETGAETESPGETTGGSAESEPPGEGEVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 960 - protein, 1417 aa, Artificial Sequence
  Description of Artificial Sequence: Synthetic polypeptide
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKGATPPETGAETESPGETTGGSAESEPPGEGEVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 961 - protein, 1393 aa, Artificial Sequence
  Description of Artificial Sequence: Synthetic polypeptide
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKGATPPETGAETESPGETTGGSAESEPPGEGEVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 962 - protein, 1414 aa, Artificial Sequence
  Description of Artificial Sequence: Synthetic polypeptide
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGATPPETGAETESPGETTGGSAESEPPGEGEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 963 - protein, 1390 aa, Artificial Sequence
  Description of Artificial Sequence: Synthetic polypeptide
DIQMTQSPSSLSTSVGDRVTLTCKASQDVGTAVDWYQQKPGPSPKLLIYWASTRHTGIPSRFSGSGSGTDFTLTISSLQPEDFADYYCQQYNSYPLTFGPGTKVDIKGATPPETGAETESPGETTGGSAESEPPGEGEVQLVQSGPEVKKPGATVKISCKTSGYTFTEYTIHWVKQAPGKGLEWIGNINPNNGGTTYNQKFEDKATLTVDKSTDTAYMELSSLRSEDTAVYYCAAGWNFDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 964 - protein, 1414 aa, Artificial Sequence
  Description of Artificial Sequence: Synthetic polypeptide
DIQMTQSPASLSASLGETVSIECLASEGISNDLAWYQQKSGKSPQLLIYATSRLQDGVPSRFSGSGSGTRYSLKISGMQPEDEADYFCQQSYKYPWTFGGGTKLELKGATPPETGAETESPGETTGGSAESEPPGEGEVQLAESGGGLVQPGRSMKLSCAASGFTFSNFPMAWVRQAPTKGLEWVATISTSGGSTYYRDSVKGRFTISRDNAKSTLYLQMNSLRSEDTATYYCTRTLYILRVFYFDYWGQGVMVTVSSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKGATPPETGAETESPGETTGGSAESEPPGEGEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGTAEAASASGLSGRSDNHSPLGLAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 965 - protein, 538 aa, Artificial Sequence
  Description of Artificial Sequence: Synthetic polypeptide
DIQMTQSPASLSASLGETVSIECLASEGISNDLAWYQQKSGKSPQLLIYATSRLQDGVPSRFSGSGSGTRYSLKISGMQPEDEADYFCQQSYKYPWTFGGGTKLELKGATPPETGAETESPGETTGGSAESEPPGEGEVQLAESGGGLVQPGRSMKLSCAASGFTFSNFPMAWVRQAPTKGLEWVATISTSGGSTYYRDSVKGRFTISRDNAKSTLYLQMNSLRSEDTATYYCTRTLYILRVFYFDYWGQGVMVTVSSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKGATPPETGAETESPGETTGGSAESEPPGEGEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGTAEAASASGLSGRSDNHSPLG

SEQ ID NO: 966 - protein, 1420 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGESGRAANTEPPELGAGPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 967 - protein, 1420 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGESGRAANTAPEGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 968 - protein, 1420 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGEPGRAANHEPSGLTEGPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 969 - protein, 1423 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGESGRAANHTGAPPGGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 970 - protein, 1423 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGTTGRAGEAANLTPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 971 - protein, 1420 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGEAGRSANHTPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 972 - protein, 1420 aa, Artificial Sequence
  Description of Artificial Sequence: Synthetic polypeptide
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGESGRAANTTPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 973 - protein, 1738 aa, Artificial Sequence
  Description of Artificial Sequence: Synthetic polypeptide
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPTTGEAGEAAGATSAGATGPATSGSETPGTDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKGATPPETGAETESPGETTGGSAESEPPGEGEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGTAEAASASGTTGEAGEAAGATSAGATGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 974 - protein, 1751 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPTTGEAGEAAGATSAGATGPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGTTGEAGEAAGATSAGATGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEPEA

SEQ ID NO: 975 - protein, 1750 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPTTGEAGEAAGATSAGATGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGTTGEAGEAAGATSAGATGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 976 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSAEATSAGATGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGEAGRSAEATSAGATGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 977 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGESANATSAGATGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGEAGESANATSAGATGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 978 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGESAGATPAGLTGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGEAGESAGATPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 979 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGTYSRGESGPGSPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGTYSRGESGPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 980 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGAEGRTDTHPGSPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGAEGRTDTHPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 981 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGEPGRAAEHPGSPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGEPGRAAEHPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 982 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSPAGESSRGTTIAGSPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSPAGESSRGTTIAGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 983 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGEPPELGAGPGSPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGEPPELGAGPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 984 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGPPPGLTGPPGSPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGPPPGLTGPPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 985 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGTPAPLGGEPGSPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGTPAPLGGEPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 986 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSPAGPPEGLETEAGSPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSPAGPPEGLETEAGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 987 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSPTSGRGGLTGPGSEPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSPTSGRGGLTGPGSEPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 988 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSAEATSAGATGPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGEAGRSAEATSAGATGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 989 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGESANATSAGATGPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGEAGESANATSAGATGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 990 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGESAGATPAGLTGPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGEAGESAGATPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 991 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGTYSRGESGPGSPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGTYSRGESGPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 992 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGAEGRTDTHPGSPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGAEGRTDTHPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 993 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGEPGRAAEHPGSPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGEPGRAAEHPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 994 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSPAGESSRGTTIAGSPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSPAGESSRGTTIAGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 995 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGEPPELGAGPGSPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGEPPELGAGPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 996 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGPPPGLTGPPGSPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGPPPGLTGPPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 997 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSASGTPAPLGGEPGSPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSASGTPAPLGGEPGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 998 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSPAGPPEGLETEAGSPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSPAGPPEGLETEAGSPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 999 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPSPTSGRGGLTGPGSEPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGSPTSGRGGLTGPGSEPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 1000 - protein, 18 aa, Artificial Sequence
  Description of Artificial Sequence: Synthetic peptide
MKNPEQAEEQAEEQREET

SEQ ID NO: 1001 - protein, 14 aa, Artificial Sequence
  Description of Artificial Sequence: Synthetic peptide
GKPIPNPLLGLDST

SEQ ID NO: 1002 - DNA, 2736 bp, Artificial Sequence
  Description of Artificial Sequence: Synthetic polynucleotide
atgaaaaacccagagcaagcagaagaacaagctgaagaacagcgcgaagaaacaggcaaaccgattccgaacccgctgctgggtctggatagcaccgaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcaccgccgaagcagctagcgcctctggcgaggcaggtcgttctgctaaccatgaaccactgggtctggttgctacgccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcacatcaccatcaccaccatcatcac

SEQ ID NO: 1003 - protein, 912 aa, Artificial Sequence
  Description of Artificial Sequence: Synthetic polypeptide
MKNPEQAEEQAEEQREETGKPIPNPLLGLDSTEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTAEAASASGEAGRSANHEPLGLVATPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAHHHHHHHH

SEQ ID NO: 1004 - protein, 16 aa, Artificial Sequence
  Description of Artificial Sequence: Synthetic peptide
LAGRSDNHSPLGLAGS

SEQ ID NO: 1005 - protein, 16 aa, Artificial Sequence
  Description of Artificial Sequence: Synthetic peptide
LAGRSDNHVPLSLSMG

SEQ ID NO: 1006 - protein, 16 aa, Artificial Sequence
  Description of Artificial Sequence: Synthetic peptide
LAGRSDNHEPLELVAG

SEQ ID NO: 1007 - protein, 19 aa, Artificial Sequence
  Description of Artificial Sequence: Synthetic peptide
TTGEAGEAAGATSAGATGP

SEQ ID NO: 1008 - DNA, 9096 bp, Artificial Sequence
  Description of Artificial Sequence: Synthetic polynucleotide
ttctcatgtttgacagcttatcatcgataagctttaatgcggtagtttatcacagttaaattgctaacgcagtcaggcaccgtgtatgaaatctaacaatgcgctcatcgtcatcctcggcaccgtcaccctggatgctgtaggcataggcttggttatgccggtactgccgggcctcttgcgggatatcgtccattccgacagcatcgccagtcactatggcgtgctgctcgcgctatatgcgttgatgcaatttctatgcgcacccgttctcggagcactgtccgaccgctttggccgccgcccagtcctgctcgcttcgctacttggagccactatcgactacgcgatcatggcgaccacacccgtcctgtggatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccgacgcgctgggctacgtcttgctggcgttcgcgacgcgaggctggatggccttccccattatgattcttctcgcttccggcggcatcgggatgcccgcgttgcaggccatgctgtccaggcaggtagatgacgaccatcagggacagcttcaaggatcgctcgcggctcttaccagcctaacttcgatcattggaccgctgatcgtcacggcgatttatgccgcctcggcgagcacatggaacgggttggcatggattgtaggcgccgccctataccttgtctgcctccccgcgttgcgtcgcggtgcatggagccgggccacctcgacctgaatggaagccggcggcacctcgctaacggattcaccactccaagaattggagccaatcaattcttgcggagaactgtgaatgcgcaaaccaacccttggcagaacatatccatcgcgtccgccatctccagcagccgcacgcggcgcatctcgggcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccacatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaattaagaaagttaatcttttcaacagctgtcataaagttgtcacggccgagacttatagtcgctttgtttttattttttaatgtatttgtaactagtacgcaagttcacgtaaaaagggtatctagacatatgaagaaaaacatcgcttttcttcttgcatctatgttcgttttttctattgctacaaacgcgtacgcttccccagcaggcagcccgaccagcaccgaggagggtacgagcgagtcggctactccagagagcggtccgggtacctctacggaaccgtccgaaggtagcgctccaggcacgtctgaaagcgcgacgccggaaagcggtccaggcagcgagccggcgacctccggtagcgaaacgcctggtacctcggagtcagcgactccggaaagcggtccgggtagcgaacctgcaacgagcggtagcgagactccaggcactagcgaatccgcaactccggagtcgggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagcccgaccagcactgaggagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggtggctcagcgcctactacaggggaggcgggggaagcagcaggggcgacttctgctggggctaccggccccgctacctcaggctccgaaaccccgggcaccgatatccagatgacccagagcccttcttccctgtccgcatccgtcggcgatcgtgtcacgattacctgtcgcagcactaagagcctgctgcactcaaacggtatcacgtacctgtactggtaccagcagaagccgggcaaagcgccgaagctgctgatttatcagatgagcaacctggcatcgggcgtgccgagccgtttcagcagcagcggtagcggtaccgacttcacgctgaccatcagctcgttgcagccagaggactttgcgacgtactattgtgcgcaaaacttggaaattccgcgcaccttcggccagggtacgaaagttgagattaaaggtgccaccccaccggagactggtgcagaaaccgagtctccgggcgaaaccacgggcggtagcgcggagagcgaaccgcctggtgagggtcaagttcaattggttcagagcggtccgggtctggttcaaccgggcggcagcgtgcgcatttcttgtgcggccagcggttacacctttacgaactacggtatgaattgggtgaaacaagctccgggcaaaggtctggagtggatgggttggatcaatacctataccggtgaatccacttacgcggattcctttaagggccgtttcaccttcagcctggacacgagcgcgagcgctgcatatctgcaaatcaatagcctgcgtgccgaagataccgcggtgtactattgcgcgcgttttgcaatcaagggcgactattggggtcaaggcacgctgctgaccgtgagcagcggtggtggcggcagcgatatccaaatgacccaatccccatcctccctgtctgcaagcgttggtgatcgtgtgacgattacgtgccgtgcctcccaagatatccgtaactacctgaattggtatcagcagaaaccgggcaaggctccgaaattgctgatctactacaccagccgcctggagtcgggtgtgcctagccgcttcagcggcagcggttcgggtaccgactataccttgaccattagcagcctgcagccggaagatttcgcgacgtattactgccaacagggtaacacgctgccgtggacctttggccaaggtaccaaagtcgagattaagggtgcgaccccgccggaaaccggtgcggaaaccgagagcccgggtgaaacgactggcggctctgcagagagcgagccgccaggtgagggcgaagtccaactggtcgagtctggtggcggcctggtgcaaccgggtggcagcctgcgtctgagctgcgctgcgagcggctatagctttaccggttataccatgaactgggttcgccaggcaccgggtaagggtctggaatgggtggcgctgatcaatccgtacaaaggtgtgagcacttacaatcagaaattcaaagaccgtttcaccattagcgttgacaagagcaagaataccgcgtatctgcagatgaacagcttgcgcgccgaggatacggccgtttactactgtgcacgtagcggctattacggtgacagcgactggtactttgacgtctggggtcagggcacgctggtcaccgttagcagcggcaccgccgaagcagctagcgcctctggcacgactggtgaagccggagaggcagctggcgcgacctcagcgggggctactgggccttctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcactaaactagttaaaagcatgcggccgcctagcataaccccttggggcctctaaacgggtcttgaggggttttttgttggcgcgccggaaatacaggaacgcacgctggatggcccttcgctgggatggtgaaaccatgaaaaatggcagcttcagtggattaagtgggggtaatgtggcctgtaccctctggttgcataggtattcatacggttaaaatttatcaggcgcgatcgcggcagtttttcgggtggtttgttgccatttttacctgtctgctgccgtgatcgcgctgaacgcgttttagcggtgcgtacaattaagggattatggtaaatccacttactgtctgccctcgtagccatcgaa

SEQ ID NO: 1009 - DNA, 5298 bp, Artificial Sequence
  Description of Artificial Sequence: Synthetic polynucleotide
atgaagaaaaacatcgcttttcttcttgcatctatgttcgttttttctattgctacaaacgcgtacgctcaccatcatcaccatcactccccagcaggcagcccgaccagcaccgaggagggtacgagcgagtcggctactccagagagcggtccgggtacctctacggaaccgtccgaaggtagcgctccaggcacgtctgaaagcgcgacgccggaaagcggtccaggcagcgagccggcgacctccggtagcgaaacgcctggtacctcggagtcagcgactccggaaagcggtccgggtagcgaacctgcaacgagcggtagcgagactccaggcactagcgaatccgcaactccggagtcgggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagcccgaccagcactgaggagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggtggctcagcgcctgaggcaggtcgttctgctaaccataccccagcggggctgactgggcctgctacctcaggctccgaaaccccgggcaccgacatccaaatgacccagagcccgagcagcctgagcgcgagcgtgggcgaccgtgttaccatcacctgccaagcgagccaagacatcagcaactacctgaactggtatcagcaaaagccgggcaaagcgccgaagctgctgatctacgacgcgagcaacctggaaaccggtgtgccgagccgtttcagcggtagcggtagcggtaccgatttcacctttaccatcagcagcctgcaaccggaggacatcgcgacctatttctgccagcactttgatcacctgccgctggcgtttggtggcggtaccaaagttgagattaaaggtgcaacgcctccggagactggtgctgaaactgagtccccgggcgagacgaccggtggctctgctgaatccgaaccaccgggcgaaggccaggtgcaactgcaggaaagcggtccgggcctggttaaaccgagcgaaaccctgagcctgacctgcaccgtgagcggcggtagcgttagcagcggtgactactattggacctggatccgtcaaagcccgggtaaaggcctggagtggatcggtcacatttactatagcggcaacaccaactacaacccgagcctgaagagccgtctgaccatcagcattgacaccagcaaaacccagttcagcctgaaactgagcagcgtgaccgcggcggataccgcgatttactattgcgttcgtgatcgtgttaccggcgcgttcgacatctggggtcagggcaccatggttaccgttagcagcggtggtggcggcagcgagttagttgtgacccaagagccgagcctgaccgttagcccgggtggtacggtcaccctgacgtgccgtagcagcaccggtgcggtcacgaccagcaactatgccaattgggtccagcagaaaccgggtcaagcaccgcgtggcctgatcggcggcaccaataaacgtgccccgggtactcctgcgcgtttctccggtagcctgctgggcggcaaagccgctctgaccctgagcggtgtccagccggaagatgaagcggagtactactgcgcgctgtggtattccaatctgtgggtttttggcggcggtaccaagctgaccgtattgggtgctacgccaccggagactggcgcagaaacggaaagcccgggtgagactacgggtggctctgcggagagcgaacctccgggtgagggtgaggtccaactgctggagtctggtggtggcctggttcaaccgggtggctcgttgaagctgagctgtgcagctagcggctttaccttcaacacctatgcgatgaattgggttcgtcaggcaccgggtaagggcctggaatgggtggcgcgtatccgctccaagtacaacaactacgcgacctactacgcggatagcgttaaagaccgcttcacgattagccgtgacgattccaagaatacggcatatctgcaaatgaacaatctgaaaaccgaagataccgcggtgtattactgtgtgcgccacggcaatttcggcaacagctacgtgagctggtttgcatattggggtcagggcaccctggttacggtgagctccggcaccgccgaagcagctagcgcctctggcgaggcaggtcgttctgctaaccataccccagcggggctgactgggcctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggcgccgcagaaccagaggcg

SEQ ID NO: 1010 - DNA, 5301 bp, Artificial Sequence
  Description of Artificial Sequence: Synthetic polynucleotide
atgaagaaaaacatcgcttttcttcttgcatctatgttcgttttttctattgctacaaacgcgtacgctcaccatcatcaccatcactccccagcaggcagcccgaccagcaccgaggagggtacgagcgagtcggctactccagagagcggtccgggtacctctacggaaccgtccgaaggtagcgctccaggcacgtctgaaagcgcgacgccggaaagcggtccaggcagcgagccggcgacctccggtagcgaaacgcctggtacctcggagtcagcgactccggaaagcggtccgggtagcgaacctgcaacgagcggtagcgagactccaggcactagcgaatccgcaactccggagtcgggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagcccgaccagcactgaggagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggtggctcagcgcctgaggcaggtcgttctgctaaccatacccctgcaggattaactggccccgccaccagcgggagcgagacccccgggactgatattcagatgacccagagcccgtcctccctgagcgcttctgttggcgaccgcgtgaccatcacctgccgtgcttcccaggatgttaacaccgctgtagcttggtatcaacagaaaccgggcaaagcaccgaaactgctgatctactctgcttcctttctgtatagcggtgttccgtctcgtttcagcggctctcgtagcggtacggattttactctgacgatcagctctctgcagccggaggacttcgctacctactactgccagcagcactacaccaccccgcctacctttggtcagggcaccaaagtggaaatcaagggtgcaacgcctccggagactggtgctgaaactgagtccccgggcgagacgaccggtggctctgctgaatccgaaccaccgggcgaaggcgaggtccagctggttgagtctggcggcggtctggtccaacctggtggctccctgcgcctgtcttgcgcagcgtccggctttaatatcaaagatacgtacattcactgggtccgccaggcaccgggcaaaggcctggaatgggttgctcgtatctacccgactaacggttatacccgttatgcagacagcgtaaagggtcgcttcacgatctccgcggatacctccaaaaacaccgcatacctgcaaatgaactctctgcgtgcggaagatactgccgtgtactactgctctcgctggggcggtgacggtttctatgcaatggactactggggtcaaggtactctggtaactgtttcctctggtggtggcggcagcgaactggtcgtcacgcaggagccgtcccttaccgtttcaccaggtggaacagtgactctgacgtgtcgctcctccactggggcggttacaacttccaattatgctaattgggtccagcagaagccgggccaagcccctcgcgggttgattggcggcaccaacaaacgtgctccagggacacctgcccgtttttcgggctccttattggggggcaaagctgcactgacgttgtctggagttcagccggaggatgaggcagagtattactgcgcattgtggtattctaatttatgggtttttggaggcggcacaaagctgaccgtcctgggtgcgaccccgccggaaaccggtgcggaaaccgaaagcccgggtgaaaccaccggtggcagcgcggagagcgaaccgccgggtgaaggtgaggttcagttgttggaaagcgggggcgggcttgtccaacctggaggttcattaaaattgagctgtgcagcctccggattcacctttaacacgtatgcaatgaactgggtccgtcaagcgcccggtaaggggctggagtgggtagctcgcatccgctcgaagtataataattacgcaacctactacgcagacagtgtcaaagatcgcttcactatctcacgcgacgacagtaagaacacggcctacttacagatgaacaatcttaaaacggaggacaccgctgtctactactgcgtgcgccacgggaatttcggtaactcttatgtaagttggttcgcatattggggacaaggtacgttggtaaccgtatccagcgggactgctgaggcggctagcgcctccggagaagctggaagaagcgccaatcacacaccagctggacttacaggcccgcctggtagccccgcggggagccctacaagcactgaggagggcacatctgagtccgctacccctgagagtggacccgggacaagcactgagcctagcgaaggaagcgcaccaggttcccccgctgggagccccacaagcacagaagagggaacttctaccgagccctctgagggctcagcccctggaactagcacagagccctccgaaggcagtgcaccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggcgccgcagaaccagaggcg

SEQ ID NO: 1011 - DNA, 5265 bp, Artificial Sequence
  Description of Artificial Sequence: Synthetic polynucleotide
atgaagaaaaacatcgcttttcttcttgcatctatgttcgttttttctattgctacaaacgcgtacgcttccccagcaggcagcccgaccagcaccgaggagggtacgagcgagtcggctactccagagagcggtccgggtacctctacggaaccgtccgaaggtagcgctccaggcacgtctgaaagcgcgacgccggaaagcggtccaggcagcgagccggcgacctccggtagcgaaacgcctggtacctcggagtcagcgactccggaaagcggtccgggtagcgaacctgcaacgagcggtagcgagactccaggcactagcgaatccgcaactccggagtcgggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagcccgaccagcactgaggagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggtggctcagcgcctgaggcaggtcgttctgctaaccataccccagcggggctgactgggcctgctacctcaggctccgaaaccccgggcaccgatatccagatgacccagagcccttcttccctgtccgcatccgtcggcgatcgtgtcacgattacctgtcgcagcactaagagcctgctgcactcaaacggtatcacgtacctgtactggtaccagcagaagccgggcaaagcgccgaagctgctgatttatcagatgagcaacctggcatcgggcgtgccgagccgtttcagcagcagcggtagcggtaccgacttcacgctgaccatcagctcgttgcagccagaggactttgcgacgtactattgtgcgcaaaacttggaaattccgcgcaccttcggccagggtacgaaagttgagattaaaggtgccaccccaccggagactggtgcagaaaccgagtctccgggcgaaaccacgggcggtagcgcggagagcgaaccgcctggtgagggtcaagttcaattggttcagagcggtccgggtctggttcaaccgggcggcagcgtgcgcatttcttgtgcggccagcggttacacctttacgaactacggtatgaattgggtgaaacaagctccgggcaaaggtctggagtggatgggttggatcaatacctataccggtgaatccacttacgcggattcctttaagggccgtttcaccttcagcctggacacgagcgcgagcgctgcatatctgcaaatcaatagcctgcgtgccgaagataccgcggtgtactattgcgcgcgttttgcaatcaagggcgactattggggtcaaggcacgctgctgaccgtgagcagcggtggtggcggcagcgatatccagatgacccaaagcccgagcagcctgccggcgagcctgggtgaccgtgtgaccatcaactgccaggcgagccaagatattagcaactacctgaactggtatcagcaaaagccgggcaaagcgccgaagctgctgatttactataccaacaagctggcggatggtgttccgagccgtttcagcggtagcggcagcggtcgtgacagcagctttaccatcagcagcctggagagcgaagatattggtagctactattgccaacaatactacaactatccgtggaccttcggtccgggcaccaaactggaaatcaaaggtgcgaccccgccggaaaccggtgcggaaaccgaaagcccgggtgaaaccaccggtggcagcgcggagagcgaaccgccgggtgaaggtgaagtgcaactggtggagagcggtggtggtctggtgcaaccgggcaagagcctgaaactgagctgcgaagcgagcggctttacctttagcggttatggtatgcattgggtgcgtcaggcgccgggtcgtggcctggagagcgttgcgtacatcaccagcagcagcatcaacattaaatatgcggacgcggtgaagggccgtttcaccgttagccgtgataacgcgaaaaacctgctgtttctgcagatgaacattctgaagagcgaggacaccgcgatgtactattgcgcgcgtttcgactgggataaaaactattggggtcaaggcaccatggtgaccgttagcagcggcaccgccgaagcagctagcgcctctggcgaggcaggtcgttctgctaaccataccccagcggggctgactgggcctccaggtagcccagctggtagcccaaccagtactgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 1012 - DNA, 5298 bp, Artificial Sequence
  Description of Artificial Sequence: Synthetic polynucleotide
atgaagaaaaacatcgcttttcttcttgcatctatgttcgttttttctattgctacaaacgcgtacgcttccccagcaggcagcccgaccagcaccgaggagggtacgagcgagtcggctactccagagagcggtccgggtacctctacggaaccgtccgaaggtagcgctccaggcacgtctgaaagcgcgacgccggaaagcggtccaggcagcgagccggcgacctccggtagcgaaacgcctggtacctcggagtcagcgactccggaaagcggtccgggtagcgaacctgcaacgagcggtagcgagactccaggcactagcgaatccgcaactccggagtcgggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagcccgaccagcactgaggagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggtggctcagcgcctgaggcaggtcgttctgctaaccataccccagcggggctgactgggcctgctacctcaggctccgaaaccccgggcaccgatatccagatgacccagagcccttcttccctgtccgcatccgtcggcgatcgtgtcacgattacctgtcgcagcactaagagcctgctgcactcaaacggtatcacgtacctgtactggtaccagcagaagccgggcaaagcgccgaagctgctgatttatcagatgagcaacctggcatcgggcgtgccgagccgtttcagcagcagcggtagcggtaccgacttcacgctgaccatcagctcgttgcagccagaggactttgcgacgtactattgtgcgcaaaacttggaaattccgcgcaccttcggccagggtacgaaagttgagattaaaggtgccaccccaccggagactggtgcagaaaccgagtctccgggcgaaaccacgggcggtagcgcggagagcgaaccgcctggtgagggtcaagttcaattggttcagagcggtccgggtctggttcaaccgggcggcagcgtgcgcatttcttgtgcggccagcggttacacctttacgaactacggtatgaattgggtgaaacaagctccgggcaaaggtctggagtggatgggttggatcaatacctataccggtgaatccacttacgcggattcctttaagggccgtttcaccttcagcctggacacgagcgcgagcgctgcatatctgcaaatcaatagcctgcgtgccgaagataccgcggtgtactattgcgcgcgttttgcaatcaagggcgactattggggtcaaggcacgctgctgaccgtgagcagcggtggtggcggcagcgagttagttgtgacccaagagccgagcctgaccgttagcccgggtggtacggtcaccctgacgtgccgtagcagcaccggtgcggtcacgaccagcaactatgccaattgggtccagcagaaaccgggtcaagcaccgcgtggcctgatcggcggcaccaataaacgtgccccgggtactcctgcgcgtttctccggtagcctgctgggcggcaaagccgctctgaccctgagcggtgtccagccggaagatgaagcggagtactactgcgcgctgtggtattccaatctgtgggtttttggcggcggtaccaagctgaccgtattgggtgctacgccaccggagactggcgcagaaacggaaagcccgggtgagactacgggtggctctgcggagagcgaacctccgggtgagggtgaggtccaactgctggagtctggtggtggcctggttcaaccgggtggctcgttgaagctgagctgtgcagctagcggctttaccttcaacacctatgcgatgaattgggttcgtcaggcaccgggtaagggcctggaatgggtggcgcgtatccgctccaagtacaacaactacgcgacctactacgcggatagcgttaaagaccgcttcacgattagccgtgacgattccaagaatacggcatatctgcaaatgaacaatctgaaaaccgaagataccgcggtgtattactgtgtgcgccacggcaatttcggcaacagctacgtgagctggtttgcatattggggtcagggcaccctggttacggtgagctccggcaccgccgaagcagctagcgcctctggcgaggcaggtcgttctgctaaccataccccagcggggctgactgggcctccaggtagcccagctggtagcccaacctctaccgaagaaggtacctctgaatccgctactccagaatccggtcctggtactagcactgagccaagcgaaggttctgctccaggctccccggcaggtagccctacctctaccgaagagggcactagcaccgaaccatctgagggttccgctcctggcacctccactgaaccgtccgaaggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 1013 - DNA, 5304 bp, Artificial Sequence
  Description of Artificial Sequence: Synthetic polynucleotide
atgaagaaaaacatcgcttttcttcttgcatctatgttcgttttttctattgctacaaacgcgtacgctcaccatcatcaccatcactccccagcaggcagcccgaccagcaccgaggagggtacgagcgagtcggctactccagagagcggtccgggtacctctacggaaccgtccgaaggtagcgctccaggcacgtctgaaagcgcgacgccggaaagcggtccaggcagcgagccggcgacctccggtagcgaaacgcctggtacctcggagtcagcgactccggaaagcggtccgggtagcgaacctgcaacgagcggtagcgagactccaggcactagcgaatccgcaactccggagtcgggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagcccgaccagcactgaggagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggtggctcagcgcctgaggcaggtcgttctgctaaccatacccctgcaggattaactggccccgccaccagcgggagcgagacccccgggactgacatccagatgacccaaagcccggcgagcctgagcgcgagcctgggtgaaaccgtgagcatcgaatgcctggcgagcgagggtattagcaacgacctggcgtggtaccagcaaaagagcggcaaaagcccgcagctgctgatctatgcgaccagccgtctgcaagatggtgttccgagccgtttcagcggtagcggtagcggtacccgttacagcctgaagattagcggtatgcagccggaggacgaagcggattatttctgccagcaaagctacaaatatccgtggacctttggtggcggtaccaagctggaactgaaaggtgcaacgcctccggagactggtgctgaaactgagtccccgggcgagacgaccggtggctctgctgaatccgaaccaccgggcgaaggcgaagttcagctggcggaaagcggcggtggcctggtgcaaccgggccgtagcatgaagctgagctgcgcggcgagcggtttcacctttagcaacttcccgatggcgtgggttcgtcaagcgccgaccaaaggcctggaatgggtggcgaccatcagcaccagcggtggcagcacctactatcgtgacagcgttaagggtcgttttaccattagccgtgataacgcgaaaagcaccctgtacctgcagatgaacagcctgcgtagcgaggacaccgcgacctactattgcacccgtaccctgtatattctgcgtgtgttctactttgattattggggccaaggtgtgatggttaccgtgagcagcggtggtggcggcagcgagttagttgtgacccaagagccgagcctgaccgttagcccgggtggtacggtcaccctgacgtgccgtagcagcaccggtgcggtcacgaccagcaactatgccaattgggtccagcagaaaccgggtcaagcaccgcgtggcctgatcggcggcaccaataaacgtgccccgggtactcctgcgcgtttctccggtagcctgctgggcggcaaagccgctctgaccctgagcggtgtccagccggaagatgaagcggagtactactgcgcgctgtggtattccaatctgtgggtttttggcggcggtaccaagctgaccgtattgggtgctacgccaccggagactggcgcagaaacggaaagcccgggtgagactacgggtggctctgcggagagcgaacctccgggtgagggtgaggtccaactgctggagtctggtggtggcctggttcaaccgggtggctcgttgaagctgagctgtgcagctagcggctttaccttcaacacctatgcgatgaattgggttcgtcaggcaccgggtaagggcctggaatgggtggcgcgtatccgctccaagtacaacaactacgcgacctactacgcggatagcgttaaagaccgcttcacgattagccgtgacgattccaagaatacggcatatctgcaaatgaacaatctgaaaaccgaagataccgcggtgtattactgtgtgcgccacggcaatttcggcaacagctacgtgagctggtttgcatattggggtcagggcaccctggtgaccgttagcagcggcaccgccgaagcggctagcgcctccggagaagctggaagaagcgccaatcacacaccagctggacttacaggcccgcctggtagccccgcggggagccctacaagcactgaggagggcacatctgagtccgctacccctgagagtggacccgggacaagcactgagcctagcgaaggaagcgcaccaggttcccccgctgggagccccacaagcacagaagagggaacttctaccgagccctctgagggctcagcccctggaactagcacagagccctccgaaggcagtgcaccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggcgccgcagaaccagaggcg

SEQ ID NO: 1014 - DNA, 5271 bp, Artificial Sequence
  Description of Artificial Sequence: Synthetic polynucleotide
atgaagaaaaacatcgcttttcttcttgcatctatgttcgttttttctattgctacaaacgcgtacgctcaccatcatcaccatcactccccagcaggcagcccgaccagcaccgaggagggtacgagcgagtcggctactccagagagcggtccgggtacctctacggaaccgtccgaaggtagcgctccaggcacgtctgaaagcgcgacgccggaaagcggtccaggcagcgagccggcgacctccggtagcgaaacgcctggtacctcggagtcagcgactccggaaagcggtccgggtagcgaacctgcaacgagcggtagcgagactccaggcactagcgaatccgcaactccggagtcgggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagcccgaccagcactgaggagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggtggctcagcgcctgaggcaggtcgttctgctaaccatacccctgcaggattaactggccccgccaccagcgggagcgagacccccgggactgacatccagatgacccaaagcccggcgagcctgagcgcgagcctgggtgaaaccgtgagcatcgaatgcctggcgagcgagggtattagcaacgacctggcgtggtaccagcaaaagagcggcaaaagcccgcagctgctgatctatgcgaccagccgtctgcaagatggtgttccgagccgtttcagcggtagcggtagcggtacccgttacagcctgaagattagcggtatgcagccggaggacgaagcggattatttctgccagcaaagctacaaatatccgtggacctttggtggcggtaccaagctggaactgaaaggtgcaacgcctccggagactggtgctgaaactgagtccccgggcgagacgaccggtggctctgctgaatccgaaccaccgggcgaaggcgaagttcagctggcggaaagcggcggtggcctggtgcaaccgggccgtagcatgaagctgagctgcgcggcgagcggtttcacctttagcaacttcccgatggcgtgggttcgtcaagcgccgaccaaaggcctggaatgggtggcgaccatcagcaccagcggtggcagcacctactatcgtgacagcgttaagggtcgttttaccattagccgtgataacgcgaaaagcaccctgtacctgcagatgaacagcctgcgtagcgaggacaccgcgacctactattgcacccgtaccctgtatattctgcgtgtgttctactttgattattggggccaaggtgtgatggttaccgtgagcagcggtggtggcggcagcgatatccagatgacccaaagcccgagcagcctgccggcgagcctgggtgaccgtgtgaccatcaactgccaggcgagccaagatattagcaactacctgaactggtatcagcaaaagccgggcaaagcgccgaagctgctgatttactataccaacaagctggcggatggtgttccgagccgtttcagcggtagcggcagcggtcgtgacagcagctttaccatcagcagcctggagagcgaagatattggtagctactattgccaacaatactacaactatccgtggaccttcggtccgggcaccaaactggaaatcaaaggtgcgaccccgccggaaaccggtgcggaaaccgaaagcccgggtgaaaccaccggtggcagcgcggagagcgaaccgccgggtgaaggtgaagtgcaactggtggagagcggtggtggtctggtgcaaccgggcaagagcctgaaactgagctgcgaagcgagcggctttacctttagcggttatggtatgcactgggtgcgtcaggcgccgggtcgtggcctggagagcgttgcgtacatcaccagcagcagcatcaacattaaatatgcggacgcggtgaagggccgtttcaccgttagccgtgataacgcgaaaaacctgctgtttctgcagatgaacattctgaagagcgaggacaccgcgatgtactattgcgcgcgtttcgactgggataaaaactattggggtcaaggcaccatggtgaccgttagcagcggcaccgccgaagcggctagcgcctccggagaagctggaagaagcgccaatcacacaccagctggacttacaggcccgcctggtagccccgcggggagccctacaagcactgaggagggcacatctgagtccgctacccctgagagtggacccgggacaagcactgagcctagcgaaggaagcgcaccaggttcccccgctgggagccccacaagcacagaagagggaacttctaccgagccctctgagggctcagcccctggaactagcacagagccctccgaaggcagtgcaccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggcgccgcagaaccagaggcg

SEQ ID NO: 1015 - DNA, 5298 bp, Artificial Sequence
  Description of Artificial Sequence: Synthetic polynucleotide
atgaagaaaaacatcgcttttcttcttgcatctatgttcgttttttctattgctacaaacgcgtacgctcaccatcatcaccatcactccccagcaggcagcccgaccagcaccgaggagggtacgagcgagtcggctactccagagagcggtccgggtacctctacggaaccgtccgaaggtagcgctccaggcacgtctgaaagcgcgacgccggaaagcggtccaggcagcgagccggcgacctccggtagcgaaacgcctggtacctcggagtcagcgactccggaaagcggtccgggtagcgaacctgcaacgagcggtagcgagactccaggcactagcgaatccgcaactccggagtcgggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagcccgaccagcactgaggagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggtggctcagcgcctgaatctggtcgtgcagctaacaccgaacctcccgagctcggggccggcgccacctcaggtagcgagacccccgggaccgatatccaaatgacacagtccccttcttctctgagcgcctctgttggcgatagagtgacaatcacctgtcaggcttctcaagatataagcaattacctgaactggtaccagcagaagcccggcaaagcccctaaactgctgatctacgatgccagcaatctggaaacaggagttcctagcagattcagcggcagcggctctggaaccgatttcacattcaccatcagctctttacagccagaggatatcgctacttacttttgccagcacttcgaccacctgcctctggcttttggcggtggtacaaaagtggagatcaaaggggccacacccccagagactggggcagagactgagtcccccggcgagacaacaggtggttccgccgagagtgaaccacccggagaaggacaggtccagctccaggagagcggaccaggactggtcaagccatctgaaaccctctctctgacgtgcaccgttagcggcggtagtgtgtcctcaggcgactactactggacatggatcagacagtcccctggcaaaggattggagtggatcggacacatttattacagcggcaacactaattataatcctagcctgaagtctagactgaccatcagcatcgacaccagcaagacccagttcagcctgaagctcagtagtgttaccgcggctgacaccgcgatctattattgcgttcgggacagagtgacaggcgcctttgatatctgggggcagggcaccatggtgactgtgagcagcggggggggcggaagtgagttggtcgttacacaagagccaagcttgaccgtgtccccgggtggcacagtaaccctcacctgccgatcctcaacaggagctgtgaccaccagcaactatgcaaattgggtgcaacaaaaacctggtcaggcaccgcgtggacttattggaggcaccaacaaaagagcacctgggacaccggcccggttttccggtagcctgcttggtggcaaggccgccctcacattatctggagtgcagcctgaggatgaagccgagtactactgcgcattgtggtacagcaacctgtgggtgtttgggggcggaaccaagttgaccgtcctgggagctaccccccccgaaactggggccgaaacggaatctcctggtgaaactacagggggaagtgcagagagcgagccaccaggagagggcgaagtccagctgctcgaatccggaggcggactcgtgcagccaggaggaagtcttaagctctcatgcgccgctagcggctttaccttcaacacatacgccatgaattgggtccgacaggctcccggtaaagggctggaatgggtggctcgaatacgttcgaagtacaacaattacgctacttactacgccgacagcgtgaaggaccgattcaccattagtcgggacgatagcaagaatacagcctacctgcagatgaacaacctgaagaccgaggataccgcggtctactattgtgtgcgccatggcaattttggcaacagctatgtgagctggtttgcctattggggccaaggcacactggttaccgtctcatctgggaccgctgaagccgctagcgcttctggggaatcaggaagagccgccaatactgaaccccccgagctgggcgctggcccaggttcccccgcggggtcccccacttctactgaagagggcacttccgagagcgctactccagagtctggccccggaacatccactgagcctagcgaggggtcggcacctgggtcacccgctggctccccaacttccaccgaggaagggacatcaaccgaaccctctgagggctccgcccccggtacttccacggagcctagtgaaggcagtgccccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggcgccgcagaaccagaggcg

SEQ ID NO: 1016 - DNA, 5268 bp, Artificial Sequence
  Description of Artificial Sequence: Synthetic polynucleotide
atgaagaaaaacatcgcttttcttcttgcatctatgttcgttttttctattgctacaaacgcgtacgcttccccagcaggcagcccgaccagcaccgaggagggtacgagcgagtcggctactccagagagcggtccgggtacctctacggaaccgtccgaaggtagcgctccaggcacgtctgaaagcgcgacgccggaaagcggtccaggcagcgagccggcgacctccggtagcgaaacgcctggtacctcggagtcagcgactccggaaagcggtccgggtagcgaacctgcaacgagcggtagcgagactccaggcactagcgaatccgcaactccggagtcgggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagcccgaccagcactgaggagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggtggctctgctcctgaatcagggagagccgcgaacacagaaccacccgagctcggcgccggagccacctctggcagcgagacacctgggacggacatccagatgacacaatccccaagctcactgtccgcatccgtcggcgaccgggttactattacatgtcgcagtacaaagtctctgctgcactctaacggcattacgtacctgtactggtaccagcaaaagcccggcaaagcccccaagctgctgatttatcagatgagtaatctggcatccggagtaccgagccggttttccagttctggaagcggcaccgacttcacgttgacgatatccagcctccagcctgaggatttcgccacctactactgcgctcagaatctggagatcccccggactttcggacagggcacaaaggtggagattaaaggcgcaacaccccccgaaactggagcagaaactgaaagccctggagaaaccaccggcggatccgccgagtcagaaccgccaggagaagggcaagttcagctcgttcagtctggcccaggactcgttcagcctggtggaagtgtgaggataagctgcgctgcctctggctataccttcacgaattacggcatgaattgggtaaaacaggcccccggaaagggcctggagtggatgggctggatcaacacctatacaggagagagtacctatgccgactcatttaaggggcggttcaccttcagcctggacacctctgcctccgccgcctacctccaaattaactcactaagagcagaggacaccgcggtgtattattgcgcaaggtttgccatcaaaggcgattactggggccaaggcaccttgcttacagtgagctctggaggaggagggtcagacattcaaatgacccagagcccaagcagtctcccagctagtctaggggatcgggttaccataaattgtcaggcttctcaagatattagtaattatctgaactggtatcaacagaagcccggtaaagcgccaaaattgctcatctactatacgaataaactggcagatggggtaccctccagattctccggtagtggttcaggccgggactcgtcgttcactattagcagcctggagtctgaggatataggcagctactactgccagcaatattacaactatccatggaccttcgggccaggcaccaagctggaaatcaagggcgcaacaccacccgagactggtgctgaaaccgaaagccccggtgaaacaacaggcggctctgcagagtcggaacctcccggagagggggaggtgcagctggtggaaagtggaggcggactggtgcaacctgggaaaagcctgaagctgtcctgtgaagcatcgggctttacatttagcgggtatggcatgcattgggtgcggcaggcgcccggtcgtggcctcgaatctgtggcctacatcactagctcttcaatcaacatcaagtacgccgatgccgtgaagggcagatttacagtgagccgggataatgccaagaacctgctgttccttcaaatgaacatcctaaagagcgaggacaccgccatgtactactgcgcaaggttcgactgggacaagaattattggggccagggcacaatggtaacagtctctagcgggacagccgaggccgctagcgcctctggagagtcggggcgagcggctaatacagaaccacctgaactgggtgccgggtctcccggtagtcctgccgggagccccacaagcactgaagagggaacctctgagtcagctaccccggaaagcggccccggcacctctacggaaccctccgagggatctgctccagggtccccggccggaagccctacctcaacagaagagggcacgtccactgagcctagcgaagggtcagcccccggaaccagcacagaaccctcagagggcagtgcaccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggctccgcaccaggtcaccatcatcaccatcac

SEQ ID NO: 1017 - DNA, 5304 bp, Artificial Sequence
  Description of Artificial Sequence: Synthetic polynucleotide
atgaagaaaaacatcgcttttcttcttgcatctatgttcgttttttctattgctacaaacgcgtacgctcaccatcatcaccatcactccccagcaggcagcccgaccagcaccgaggagggtacgagcgagtcggctactccagagagcggtccgggtacctctacggaaccgtccgaaggtagcgctccaggcacgtctgaaagcgcgacgccggaaagcggtccaggcagcgagccggcgacctccggtagcgaaacgcctggtacctcggagtcagcgactccggaaagcggtccgggtagcgaacctgcaacgagcggtagcgagactccaggcactagcgaatccgcaactccggagtcgggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagcccgaccagcactgaggagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggtggctcagcgcctgaatctggtcgtgcagctaacaccgaacctcctgaattgggagccggtgctacaagcggaagtgagacccccgggaccgatatccagatgacacagagcccttcttctctgagcgcctctgttggcgatagagtgacaatcacctgtaggtcgacgaagtctctgctgcacagcaatggcatcacctacctatactggtatcaacaaaagccgggtaaagcacctaaactgctgatctaccagatgagtaatctggcctctggagttcctagccgattttcttcatctggctctggcaccgattttacactgaccatctctagcctgcagcctgaggattttgccacctactattgcgcccagaacctggaaatcccaaggacatttggacagggcaccaaggtggagattaagggggcaacacctcctgaaacaggggccgagacagagagccccggtgagacaactggcgggtctgctgagagcgagcctcccggtgaaggacaggtccaactggttcagtctgggcctgggctggtccagcccggcggttccgtgaggattagttgtgctgccagcggctacactttcaccaattatgggatgaactgggttaagcaggccccaggtaagggtctggaatggatgggctggatcaacacttacaccggagaatctacctatgccgattccttcaaagggaggtttactttctctctggacaccagtgccagtgccgcttacctgcagatcaattcattgagggcggaagataccgcggtgtattactgcgcccggttcgctatcaaaggcgactattgggggcaaggtacgttactaacagtgtcgtctggcgggggaggatctgaattagttgtgacccaagagccaagcctgactgtgagcccaggcggcacagtgaccctgacctgtcgctcctccaccggagctgtgacaaccagcaattatgccaactgggtgcagcagaaaccaggtcaggcaccgcgtggacttattggcggcaccaacaaaagagctccaggaacaccagccagattttctggctctctgcttggcggaaaagctgccctgacattatctggagttcagcctgaagatgaggcggaatattactgtgctctgtggtacagcaacctgtgggtgtttggaggaggtaccaaactcacagttctgggagccacccccccagagactggtgctgagacggaatctccaggagaaaccactggaggatcagctgagagcgaaccacccggagagggcgaagtgcagctcctcgaatccgggggcggtttagttcagcccggaggttctctcaagctgagctgtgcagctagcggattcacatttaacacatatgccatgaattgggtgcggcaggctcccggtaagggtctggagtgggtggcccgaatccgcagcaagtacaataactacgccacgtactatgccgactccgtgaaggacaggttcactatatctcgcgacgatagcaagaatacagcctacctgcagatgaacaacctcaaaacagaggacaccgcggtatattattgcgtgagacacgggaactttggaaacagctatgtgagctggtttgcctactggggtcagggcaccctggtaaccgtgagctctgggacagccgaggccgctagcgcctccggcgaatccggaagagccgccaatactgaacctcccgaactcggcgccggtcctggtagtcccgcgggctctccaacatcaaccgaagagggcactagcgaatccgcaacccctgagagcgggcccggcacttctaccgaaccttcggagggctcagcccctggctcgcccgctggtagtcccacctccaccgaggaaggcacaagcaccgagccctcagagggcagcgcacccggtacatccacagagccctctgagggcagtgctccgggtacttccgaaagcgcaactccggaatccggccctggttctgagcctgctacttccggctctgaaactccaggtagcgagccagcgacttctggttctgaaactccaggttcaccggcgggtagcccgacgagcacggaggaaggtacctctgagtcggccactcctgagtccggtccgggcacgagcaccgagccgagcgagggttcagccccgggtaccagcacggagccgtccgagggtagcgcaccgggttctccggcgggctcccctacgtctacggaagagggtacgtccactgaacctagcgagggcagcgcgccaggcaccagcactgaaccgagcgaaggcagcgcacctggcactagcgagtctgcgactccggagagcggtccgggtacgagcacggaaccaagcgaaggcagcgccccaggtacctctgaatctgctaccccagaatctggcccgggttccgagccagctacctctggttctgaaaccccaggtacttccactgaaccaagcgaaggtagcgctcctggcacttctactgaaccatccgaaggttccgctcctggtacgtctgaaagcgctacccctgaaagcggcccaggcacctctgaaagcgctactcctgagagcggtccaggctctccagcaggttctccaacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttctgagagcgccactcctgaatccggccctggtagcgagccggcaacctccggctcagaaactcctggttcggaaccagcgaccagcggttctgaaactccgggtagcccggcaggcagcccaacgagcaccgaagagggtaccagcacggaaccgagcgagggttctgccccgggtacttccaccgaaccatcggagggctctgcacctggtagcgaacctgcgacgtctggttctgaaacgccgggtaccagcgaaagcgctaccccagaatccggtccgggcactagcaccgagccatcggagggcgccgcagaaccagaggcg

SEQ ID NO: 1018 - protein, 1745 aa, Artificial Sequence
  Description of Artificial Sequence: Synthetic polypeptide
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPTTGEAGEAAGATSAGATGPATSGSETPGTDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLSASVGDRVTITCRASQDIRNYLNWYQQKPGKAPKLLIYYTSRLESGVPSRFSGSGSGTDYTLTISSLQPEDFATYYCQQGNTLPWTFGQGTKVEIKGATPPETGAETESPGETTGGSAESEPPGEGEVQLVESGGGLVQPGGSLRLSCAASGYSFTGYTMNWVRQAPGKGLEWVALINPYKGVSTYNQKFKDRFTISVDKSKNTAYLQMNSLRAEDTAVYYCARSGYYGDSDWYFDVWGQGTLVTVSSGTAEAASASGTTGEAGEAAGATSAGATGPSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 1019 - protein, 1745 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGEAGRSANHTPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEPEA

SEQ ID NO: 1020 - protein, 1744 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGATPPETGAETESPGETTGGSAESEPPGEGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGEAGRSANHTPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 1021 - protein, 1732 aa, Artificial Sequence
  Description of Artificial Sequence: Synthetic polypeptide
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKGATPPETGAETESPGETTGGSAESEPPGEGEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGTAEAASASGEAGRSANHTPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 1022 - protein, 1743 aa, Artificial Sequence
  Description of Artificial Sequence: Synthetic polypeptide
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGEAGRSANHTPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 1023 - protein, 1745 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTDIQMTQSPASLSASLGETVSIECLASEGISNDLAWYQQKSGKSPQLLIYATSRLQDGVPSRFSGSGSGTRYSLKISGMQPEDEADYFCQQSYKYPWTFGGGTKLELKGATPPETGAETESPGETTGGSAESEPPGEGEVQLAESGGGLVQPGRSMKLSCAASGFTFSNFPMAWVRQAPTKGLEWVATISTSGGSTYYRDSVKGRFTISRDNAKSTLYLQMNSLRSEDTATYYCTRTLYILRVFYFDYWGQGVMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGEAGRSANHTPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 1024 - protein, 1734 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPEAGRSANHTPAGLTGPATSGSETPGTDIQMTQSPASLSASLGETVSIECLASEGISNDLAWYQQKSGKSPQLLIYATSRLQDGVPSRFSGSGSGTRYSLKISGMQPEDEADYFCQQSYKYPWTFGGGTKLELKGATPPETGAETESPGETTGGSAESEPPGEGEVQLAESGGGLVQPGRSMKLSCAASGFTFSNFPMAWVRQAPTKGLEWVATISTSGGSTYYRDSVKGRFTISRDNAKSTLYLQMNSLRSEDTATYYCTRTLYILRVFYFDYWGQGVMVTVSSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKGATPPETGAETESPGETTGGSAESEPPGEGEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGTAEAASASGEAGRSANHTPAGLTGPPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 1025 - protein, 1743 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPESGRAANTEPPELGAGATSGSETPGTDIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKGATPPETGAETESPGETTGGSAESEPPGEGQVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGESGRAANTEPPELGAGPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 1026 - protein, 1733 aa, Artificial Sequence
  Description of Artificial Sequence: Synthetic polypeptide
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPESGRAANTEPPELGAGATSGSETPGTDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSDIQMTQSPSSLPASLGDRVTINCQASQDISNYLNWYQQKPGKAPKLLIYYTNKLADGVPSRFSGSGSGRDSSFTISSLESEDIGSYYCQQYYNYPWTFGPGTKLEIKGATPPETGAETESPGETTGGSAESEPPGEGEVQLVESGGGLVQPGKSLKLSCEASGFTFSGYGMHWVRQAPGRGLESVAYITSSSINIKYADAVKGRFTVSRDNAKNLLFLQMNILKSEDTAMYYCARFDWDKNYWGQGTMVTVSSGTAEAASASGESGRAANTEPPELGAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGHHHHHH

SEQ ID NO: 1027 - protein, 1745 aa, Artificial Sequence
  Description of Artificial Sequence: Synthetic polypeptide
HHHHHHSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAPESGRAANTEPPELGAGATSGSETPGTDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVEIKGATPPETGAETESPGETTGGSAESEPPGEGQVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSGGGGSELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSSGTAEAASASGESGRAANTEPPELGAGPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

What is claimed is:

1. A recombinant polypeptide, comprising a first release segment (RS1) comprising the amino acid sequence of SEQ ID NO: 47, wherein the recombinant polypeptide further comprises a first binding moiety (FBM) having binding affinity for a target cell marker on a target tissue or cell.

2. The recombinant polypeptide of claim 1, wherein upon administration of the recombinant polypeptide to a subject having a tumor, the RS1 is capable of being cleaved when in proximity to the tumor, wherein the tumor or surrounding tissue is expressing one or more proteases for which the RS1 is a substrate.

3. The recombinant polypeptide of claim 1, wherein the FBM is an antibody, a cytokine, a cell receptor, or a fragment thereof.

4. The recombinant polypeptide of claim 1, wherein the FBM is an antibody or a fragment thereof.

5. The recombinant polypeptide of 4, wherein the antibody fragment is selected from group consisting of an Fv, Fab, Fab', Fab'-SH, linear antibody, and a single-chain variable fragment (scFv).

6. The recombinant polypeptide of claim 4, wherein the FBM binds specifically to CD3.

7. The recombinant polypeptide of claim 1, wherein the FBM is a cytokine or a fragment thereof.

8. The recombinant polypeptide of claim 1, wherein the FBM is a cell receptor or a fragment thereof.

9. The recombinant polypeptide of claim 8, wherein the RS1 is positioned between the FBM and the bulking moiety.

10. The recombinant polypeptide of claim 9, wherein the FBM binds specifically to CD3.

11. The recombinant polypeptide of claim 9, wherein the SBM binds specifically to a target cell marker on a tumor cell.

12. The recombinant polypeptide of claim 1, further comprising a second binding moiety (SBM) fused to the FBM by a peptide linker, wherein the SBM is an antibody fragment having binding affinity for a target cell marker, wherein the antibody fragment is selected from the group consisting of Fv, Fab, Fab', Fab'-SH, linear antibody, a single domain antibody, and single-chain variable fragment (scFv), or the VL and VH of the FBM and SBM are configured as a single chain diabody.

13. The recombinant polypeptide of claim 12, wherein following the administration of a therapeutically effective single dose of the recombinant polypeptide to a subject having one or more tumor-associated proteases capable of cleaving the RS1, the RS1 is cleaved thereby releasing the fused FBM and SBM from the recombinant polypeptide wherein the fused FBM and SBM exhibit a terminal half-life that is at least five-fold less compared to the terminal half-life of the corresponding recombinant polypeptide that is not cleaved in the subject.

14. The recombinant polypeptide of claim 12, wherein following the administration of a therapeutically effective single dose of the recombinant polypeptide to a subject having a tumor-associated protease capable of cleaving the RS1, the plasma area under the curve of the released FBM and SBM is at least 10-fold lower compared to the plasma area under the curve of the uncleaved recombinant polypeptide in the subject.

15. The recombinant polypeptide of claim 1, further comprising a first extended recombinant polypeptide.

16. The recombinant polypeptide of claim 15, further comprising
   i) a second release segment (RS2) that is cleaved by a mammalian protease,
   ii) a second extended recombinant polypeptide, and
   iii) a second binding moiety (SBM) comprising an antibody or a fragment thereof, wherein in an uncleaved state, the recombinant polypeptide has a structural arrangement from N-terminus to C-terminus as follows: first extended recombinant polypeptide-RS1-SBM-FBM-RS2-second extended recombinant polypeptide, first extended recombinant polypeptide-RS1-FBM-SBM-RS2-second extended recombinant polypeptide, second extended recombinant polypeptide-RS2-SBM-FBM-RS1-first extended recombinant polypeptide, or second extended recombinant polypeptide-RS2-FBM-SBM-RS1-first extended recombinant polypeptide.

17. The recombinant polypeptide of claim 16, wherein the RS2 sequence is identical compared to the RS1 sequence.

18. The recombinant polypeptide of claim 1, wherein the recombinant polypeptide further comprises a bulking moiety selected from the group consisting of an extended recombinant polypeptide; an albumin binding domain; an albumin polypeptide; an IgG binding domain; a polypeptides of at least 350 amino acid residues consisting of proline, serine, and alanine; a fatty acid; an elastin-like protein, an Fc domain, a polyethylene glycol (PEG), poly(lactic-co-glycolic acid) (PLGA), and a hydoxylethyl starch.

19. A pharmaceutical composition comprising the recombinant polypeptide of claim 1 and one or more pharmaceutically suitable excipients.

20. A recombinant polypeptide comprising a structural arrangement from N-terminus to C-terminus selected from: first extended recombinant polypeptide-RS1-SBM-FBM-RS2-second extended recombinant polypeptide, first extended recombinant polypeptide-RS1-FBM-SBM-RS2-second extended recombinant polypeptide, second extended recombinant polypeptide-RS2-SBM-FBM-RS1-first extended recombinant polypeptide, and second extended recombinant polypeptide-RS2-FBM-SBM-RS1-first extended recombinant polypeptide, wherein RS1 comprises a first release segment comprising the amino acid sequence of SEQ ID NO: 47;

FBM is a first binding moiety comprising an antibody or a fragment thereof;

SBM is a second binding moiety comprising an antibody or a fragment thereof; and RS2 is a second release segment comprising the amino acid sequence of SEQ ID NO: 47.

* * * * *